United States Patent 11,098,302 (IDENTIFICATION OF POLYNUCLEOTIDES ASSOCIATED WITH A SAMPLE) - sequence listing, part 51

SEQ ID NO: 174069 - DNA, 256 bp, Homo sapiens; identical to SEQ ID NO: 173524
  misc_feature: GYAE6OF02HA01Z.49.65.F10.1.454.CMB.1.raw
  modified_base (254)..(256): a, c, t, g, unknown or other
  misc_feature (254)..(256): n is a, c, g, or t

SEQ ID NO: 174070 - DNA, 294 bp, Homo sapiens
  misc_feature: GYAE6OF02ILLDL.49.65.F10.1.454.CMB.1.raw
  modified_base (292)..(294): a, c, t, g, unknown or other
  misc_feature (292)..(294): n is a, c, g, or t
tcagagtcgagagacacgaccggtgctcgatttagctacgctctaagggcgacgaccggtgctcgatttagctacgcgttcgtaggggacacggccaccctgacccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnn

SEQ ID NO: 174071 - DNA, 541 bp, Homo sapiens
  misc_feature: GYAE6OF02GO3TI.49.65.F10.1.454.CMB.1.raw
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctntggattcaccttcaagaactttggcatgcactgggtccncaggctccaggcacggggctggagtgggtggcagttatctcagatgatggaataaaagtctatcgactctgaaggccgatcaccatctccagagacaattacaagaacacctgcatctaacaatgacacagtctgagacctgaggacacgctgtgtattactgtgacggtaagggggtagggtaagttttggacgttagttacggtaccctacgttcggaccgtacggtcgggtacccgtaaccgggg

SEQ ID NO: 174072 - DNA, 558 bp, Homo sapiens
  misc_feature: GYAE6OF02JKFO0.49.65.F10.1.454.CMB.1.raw
  modified_base (293)..(293): a, c, t, g, unknown or other
  misc_feature (293)..(293): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccnccaggcctccaggcacggggctggagtgggtgcagttatctcagatgatggaaagtaaaagtctagttcggactcgttaggaaggtccattccaccatctaccagagaactaatccaagaacacttgacatactaacaatcgacacagtctagacgacctgacgacacggctaggtgtaacttctgtacggacgggtaagggggtcgggttaattttcggcgtagttacggaccctagttcgacgtacgtggggaccgtaacggg

SEQ ID NO: 174073 - DNA, 254 bp, Homo sapiens; identical to SEQ ID NO: 173462
  misc_feature: GYAE6OF02FV13M.49.65.F10.1.454.CMB.1.raw
  modified_base (253)..(254): a, c, t, g, unknown or other
  misc_feature (253)..(254): n is a, c, g, or t

SEQ ID NO: 174074 - DNA, 255 bp, Homo sapiens
  misc_feature: GYAE6OF02IKS4J.49.65.F10.1.454.CMB.1.raw
  modified_base (255)..(255): a, c, t, g, unknown or other
  misc_feature (255)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggccaaccccactgtcactctgttcccgccctcctctctctcgactctgagcgggctggcaaggcgcatagn

SEQ ID NO: 174075 - DNA, 294 bp, Homo sapiens
  misc_feature: GYAE6OF02JFDPA.49.65.F10.1.454.CMB.1.raw
  modified_base (257)..(294): a, c, t, g, unknown or other
  misc_feature (257)..(294): n is a, c, g, or t
tcagagtcgagagacacgaccggtgctcgatttagctacgctctaagggacgacgggccaccctgaccatcagcagggtcgaagccggggatgaggccgactattactgtcacgtgtggggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnnnnnnnnnnnnnnnnnnnnnnnnnnnnnnnn

SEQ ID NO: 174076 - DNA, 270 bp, Homo sapiens
  misc_feature: GYAE6OF02JEG73.49.65.F10.1.454.CMB.1.raw
  modified_base (250)..(250): a, c, t, g, unknown or other
  misc_feature (250)..(250): n is a, c, g, or t
  modified_base (255)..(270): a, c, t, g, unknown or other
  misc_feature (255)..(270): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtacgtagtgatcatgtggtgttcggcggagggaccaagctgaccgtcctaggtcagcccaaggctgccccctggtcactctgttcccgccctcctctctcgtcgactctgagcgggctggcaaggcnatagnnnnnnnnnnnnnnnn

SEQ ID NO: 174077 - DNA, 286 bp, Homo sapiens
  misc_feature: GYAE6OF02GTJYM.49.65.F10.1.454.CMB.1.raw
  modified_base (285)..(286): a, c, t, g, unknown or other
  misc_feature (285)..(286): n is a, c, g, or t
tcagagtcgagagacacgaccggtgctcgatttagctacgctctaagggcacgaccggtgctcgatttagctacgctctaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgcccctggtcactctgttcccgcctcctctctctcgactctgagcgggctggcaaggcgcatagnn

SEQ ID NO: 174078 - DNA, 254 bp, Homo sapiens; identical to SEQ ID NO: 173581
  misc_feature: GYAE6OF02HOPCE.49.65.F10.1.454.CMB.1.raw
  modified_base (254)..(254): a, c, t, g, unknown or other
  misc_feature (254)..(254): n is a, c, g, or t

SEQ ID NO: 174079 - DNA, 260 bp, Homo sapiens
  misc_feature: GYAE6OF02I3W23.49.65.F10.1.454.CMB.1.raw
  modified_base (253)..(260): a, c, t, g, unknown or other
  misc_feature (253)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcccttcctctctctcgactctgagcggctggcaaggcgcatagnnnnnnnn

SEQ ID NO: 174080 - DNA, 292 bp, Homo sapiens
  misc_feature: GYAE6OF02FF6P4.49.65.F10.1.454.CMB.1.raw
  modified_base (250)..(250): a, c, t, g, unknown or other
  misc_feature (250)..(250): n is a, c, g, or t
  modified_base (256)..(258): a, c, t, g, unknown or other
  misc_feature (256)..(258): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(292): a, c, t, g, unknown or other
  misc_feature (265)..(292): n is a, c, g, or t
tcagagtcgagagacacgaccggtgctcgatttagctacgctctaaggggacgacgggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctcgtctctcgactctgagcgggctggcaaggcncatagnnntgnancnnnnnnnnnnnnnnnnnnnnnnnnnnnn

SEQ ID NO: 174081 - DNA, 257 bp, Homo sapiens; identical to SEQ ID NO: 173534
  misc_feature: GYAE6OF02JICPU.49.65.F10.1.454.CMB.1.raw
  modified_base (254)..(257): a, c, t, g, unknown or other
  misc_feature (254)..(257): n is a, c, g, or t

SEQ ID NO: 174082 - DNA, 256 bp, Homo sapiens; identical to SEQ ID NO: 173524
  misc_feature: GYAE6OF02HHO92.49.65.F10.1.454.CMB.1.raw
  modified_base (254)..(256): a, c, t, g, unknown or other
  misc_feature (254)..(256): n is a, c, g, or t

SEQ ID NO: 174083 - DNA, 256 bp, Homo sapiens
  misc_feature: GYAE6OF02IO51S.49.65.F10.1.454.CMB.1.raw
  modified_base (250)..(256): a, c, t, g, unknown or other
  misc_feature (250)..(256): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtctaggtcagcccaaggctgccccctggtcactctgttcccgcctcctctctctcgactctgagcgggctggcaaggcgcatagnnnnnnn

SEQ ID NO: 174084 - DNA, 254 bp, Homo sapiens
  misc_feature: GYAE6OF02FUE1G.49.65.F10.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgagcgggctggcaaggcgcatagnnn

SEQ ID NO: 174085 - DNA, 255 bp, Homo sapiens
  misc_feature: GYAE6OF02F2ELZ.49.65.F10.1.454.CMB.1.raw
  modified_base (255)..(255): a, c, t, g, unknown or other
  misc_feature (255)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagn

SEQ ID NO: 174086 - DNA, 271 bp, Homo sapiens
  misc_feature: GYAE6OF02IG4MU.49.65.F10.1.454.CMB.1.raw
  modified_base (257)..(271): a, c, t, g, unknown or other
  misc_feature (257)..(271): n is a, c, g, or t
tcagagtcgagagacacgaccggtgctcgatttagctacgctctaagggacacggccaccctgaccatcagcagggtcgaagtccggggatgaggccgactattactgtcacgtgtgggacagtagtagtgatcatgtggtgttcggcggagggaccaagctgaccgtcctaggtcagcccaaggctgccccctcggtcactctgttcccgccctccgtctctctcgactctgagcgggctggccaaggcgcatagnnnnnnnnnnnnnnn

SEQ ID NO: 174087 - DNA, 620 bp, Homo sapiens
  misc_feature: GYAE6OF02HHA7F.49.65.F10.1.454.CMB.1.raw
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
tcagagtcgagagacacgaccggtgctcgatttagctacgctctaagggcgacggggaccggtgcgtcgatttagctacgctctaggggacacggccaccctgaccagtcaggcagggtcgaagccggggatcgaggcccgactattactgtcgacgtgtggggacaggtacgtagtgatccatgtggtgttcggcggagggccaagcgtgaccgtctaggtcaggcccaaggcctgcccctggtcactctggtacccgcctctctctcgcgacttctgagtcgggctggccaagggccacatacgnacgccancatatatgctacatcgtaccncgtgtcgtcngtctcgtctcgacgtcgtactactacgtcgtacgacaacgtccgtacctccgtacgtactcgtacgtcgtacggtcgtacgtacgtacgtacgtacggtacggtacgtacgtacgttacgttcgttcgttcgtcgtcgtacgtacgtacgtacgtacgtcgttcggttacggttcggtacggtacggtacgtacgtacggtacgtacggttacggtacgtacgtacgtacgtacgtaccgtaccgtccgtaccgtaccgtacgtccgtccgtccg

SEQ ID NO: 174088 - DNA, 293 bp, Homo sapiens
  misc_feature: GYAE6OF02IBWGZ.49.65.F10.1.454.CMB.1.raw
  modified_base (289)..(293): a, c, t, g, unknown or other
  misc_feature (289)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttccccgccctcctctctctcgactctgagcgggctggcaaggcgcatagnnnnn

SEQ ID NO: 174089 - DNA, 272 bp, Homo sapiens
  misc_feature: GYAE6OF02IZRFQ.49.65.F10.1.454.CMB.1.raw
  modified_base (258)..(272): a, c, t, g, unknown or other
  misc_feature (258)..(272): n is a, c, g, or t
tcagagtcgagagacacgaccggtgctcgatttagctacgctctaaggggacacggccaccctgaccatcagcagggtcgaagccggggatgaggccgactatttactgtcacgtgtgggacaggtagtagtgatcatggtggtgttcggcggagggaccaaggctgaccgtcctaggtcagcccaaggctgccccctcggtcactctgtttcccacctcctctctctcgactctgagcggctggcaaggcgcatagnnnnnnnnnnnnnnn

SEQ ID NO: 174090 - DNA, 256 bp, Homo sapiens; identical to SEQ ID NO: 173568
  misc_feature: GYAE6OF02F1CA8.49.65.F10.1.454.CMB.1.raw
  modified_base (255)..(256): a, c, t, g, unknown or other
  misc_feature (255)..(256): n is a, c, g, or t

SEQ ID NO: 174091 - DNA, 292 bp, Homo sapiens
  misc_feature: GYAE6OF02FUSNP.49.65.F10.1.454.CMB.1.raw
  modified_base (289)..(292): a, c, t, g, unknown or other
  misc_feature (289)..(292): n is a, c, g, or t
tcagagtcgagagacacgaccggtgctcgatttagctacgctctaagggcacgaccggtgctcgatttagctacgctctagaggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnnn

SEQ ID NO: 174092 - DNA, 285 bp, Homo sapiens
  misc_feature: GYAE6OF02IXPUR.49.65.F10.1.454.CMB.1.raw
  modified_base (254)..(285): a, c, t, g, unknown or other
  misc_feature (254)..(285): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctggttcccacctcctctctctcgactctgagcgggactggcaaggcgcatagnnnnnnnnnnnnnnnnnnnnnnnnnnnnnnnn

SEQ ID NO: 174093 - DNA, 257 bp, Homo sapiens; identical to SEQ ID NO: 173609
  misc_feature: GYAE6OF02G5ZMS.49.65.F10.1.454.CMB.1.raw
  modified_base (254)..(257): a, c, t, g, unknown or other
  misc_feature (254)..(257): n is a, c, g, or t

SEQ ID NO: 174094 - DNA, 291 bp, Homo sapiens
  misc_feature: GYAE6OF02FLEDW.49.65.F10.1.454.CMB.1.raw
  modified_base (287)..(291): a, c, t, g, unknown or other
  misc_feature (287)..(291): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnn

SEQ ID NO: 174095 - DNA, 627 bp, Homo sapiens
  misc_feature: GYAE6OF02GLD19.49.65.F10.1.454.CMB.1.raw
  modified_base (335)..(335): a, c, t, g, unknown or other
  misc_feature (335)..(335): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcgtgggttttcctcgttgcttcttttaagaggtgtcctagtgtcaggtgcagctggtggagtcgtgggggaggcgtgggtccaggcctgggagtccctgagactctcctgtgacgcctctggattccaccttcaagtactttggcatgctactgggtccgccaggctccgaggccacggggctgggaggtggggnggctagttactcgtacagatgaagtaggaaagtaaaaagtcgtaatttcggactccgtaggaacgggtcctaattccgaacctatcctaccgacgacgaacaactaccaaacgaacctaccttagacctactacttaacaatcgacactacgtactagacgacgtagacggacgacggacgttgtacgtagttacgtggtacggacgggtaagggggtagggttagttttaggacgttagttacggtacccgtacgttcggtaaccgtacggttcggggaccgtaaccgggg

SEQ ID NO: 174096 - DNA, 256 bp, Homo sapiens; identical to SEQ ID NO: 173490
  misc_feature: GYAE6OF02HO19O.49.65.F10.1.454.CMB.1.raw
  modified_base (254)..(256): a, c, t, g, unknown or other
  misc_feature (254)..(256): n is a, c, g, or t

SEQ ID NO: 174097 - DNA, 256 bp, Homo sapiens; identical to SEQ ID NO: 173466
  misc_feature: GYAE6OF02JDJII.49.65.F10.1.454.CMB.1.raw
  modified_base (253)..(256): a, c, t, g, unknown or other
  misc_feature (253)..(256): n is a, c, g, or t

SEQ ID NO: 174098 - DNA, 257 bp, Homo sapiens; identical to SEQ ID NO: 173521
  misc_feature: GYAE6OF02FLCSS.49.65.F10.1.454.CMB.1.raw
  modified_base (254)..(257): a, c, t, g, unknown or other
  misc_feature (254)..(257): n is a, c, g, or t

SEQ ID NO: 174099 - DNA, 255 bp, Homo sapiens
  misc_feature: GYAE6OF02GLOGE.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgcctcctctctctcgactctgagcgggctggcaaggcgcatagnn

SEQ ID NO: 174100 - DNA, 552 bp, Homo sapiens
  misc_feature: GYAE6OF02GXYVG.49.65.F10.1.454.CMB.1.raw
  modified_base (254)..(254): a, c, t, g, unknown or other
  misc_feature (254)..(254): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctntggattcaccttcaagaactttggcatgcactgggtccgccaggctccaggcacggggctggagtgggtggcagttatctcagatgatggaagtaaaagtactattcggactccttgaaggccgattcaccatctccagagacaattaccaagaacaccttgcatactaacaaatgacacagtctgacgacctgagacacggctgtgtaattactgtgacggaagggggtaggggtagtttttcggacgtagttcggtaccctacgttgaaccgttacgtacggggccgtaaccgggg

SEQ ID NO: 174101 - DNA, 254 bp, Homo sapiens; identical to SEQ ID NO: 173462
  misc_feature: GYAE6OF02INC0O.49.65.F10.1.454.CMB.1.raw
  modified_base (253)..(254): a, c, t, g, unknown or other
  misc_feature (253)..(254): n is a, c, g, or t

SEQ ID NO: 174102 - DNA, 293 bp, Homo sapiens
  misc_feature: GYAE6OF02FVTFC.49.65.F10.1.454.CMB.1.raw
  modified_base (288)..(293): a, c, t, g, unknown or other
  misc_feature (288)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnn

SEQ ID NO: 174103 - DNA, 309 bp, Homo sapiens
  misc_feature: GYAE6OF02HOJJ9.49.65.F10.1.454.CMB.1.raw
  modified_base (263)..(264): a, c, t, g, unknown or other
  misc_feature (263)..(264): n is a, c, g, or t
  modified_base (266)..(270): a, c, t, g, unknown or other
  misc_feature (266)..(270): n is a, c, g, or t
  modified_base (273)..(309): a, c, t, g, unknown or other
  misc_feature (273)..(309): n is a, c, g, or t
tcagagtcgagagacacgaccggtgctcgatttagctacgctctaaggggacacgggcccgaaccctgacccatcagcagggtcgaagccggggatgaggccgactattactgtcacgtgtgggacagtagtagttgatcatgtggtgttcggcggagggaccaagctgaccgtcctaggtcagcccaaggctgccccctggtcactctgttcccgccctccgtctcgtctcgactctggagcgggctggcaaggcgcatagnnannnnntgnnnnnnnnnnnnnnnnnnnnnnnnnnnnnnnnnnnnn

SEQ ID NO: 174104 - DNA, 716 bp, Homo sapiens
  misc_feature: GYAE6OF02H9DK0.49.65.F10.1.454.CMB.1.raw
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgagcctctggattcaccttnaagtaactttggcatgcacgtgggtccnccgaggcctccgaggccgacggggctggaggtggggtcggctaggttactctacgaggactaggaagtaagggtaaaagttaaaaagtcgtaacgttacgggaacttccgttaggaaacgggtccgtaatttccgaacctatcctacgaaggtacgtaactaacttacccgaaagtaaccctaccttacgacctaacttaccttaacaaattcgacctaactacgtacctagtaaccggtaaccgtaggaacggaccgtaccgggtcttagggttacgttaacgtttaccgtggttacgggtacggggtaagggggggttaacggggtttaagtttttcgggaccgtttaacggttccgggttaacccgttacggtttaacggtaccggttaaccggttccgggggtaccgtaacccgggg

SEQ ID NO: 174105 - DNA, 256 bp, Homo sapiens
  misc_feature: GYAE6OF02I6HOT.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctagatcagcccaaggctgccccctcggtcactctgttcccaccctcctctctctcgactctgagcgggctggcaaggcgcatagnnn

SEQ ID NO: 174106 - DNA, 255 bp, Homo sapiens
  misc_feature: GYAE6OF02GNUNS.49.65.F10.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnn

SEQ ID NO: 174107 - DNA, 325 bp, Homo sapiens
  misc_feature: GYAE6OF02JYNN0.49.65.F10.1.454.CMB.1.raw
  modified_base (257)..(257): a, c, t, g, unknown or other
  misc_feature (257)..(257): n is a, c, g, or t
  modified_base (262)..(263): a, c, t, g, unknown or other
  misc_feature (262)..(263): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (276)..(325): a, c, t, g, unknown or other
  misc_feature (276)..(325): n is a, c, g, or t
tcagagtcgagagacacgaccggtgctcgatttagctacgctctaagggacgacggccaccctgaccatcagcagggtcgaagccgggggatgaggccgactattactgtcacgtgtgggacagtagtagtgatcatgtggtgttcggcggagggaccaagctgaccgtcctaggtcagcccaaggctgccccctggtcactctaggttcccacccgtctctctacgtcgactctggagtcgggctgggcaaggcgnatagnncancanctagcannnnnnnnnnnnnnnnnnnnnnnnnnnnnnnnnnnnnnnnnnnnnnnnnn

SEQ ID NO: 174108 - DNA, 287 bp, Homo sapiens
  misc_feature: GYAE6OF02HL53H.49.65.F10.1.454.CMB.1.raw
  modified_base (287)..(287): a, c, t, g, unknown or other
  misc_feature (287)..(287): n is a, c, g, or t
tcagagtcgagagacacgaccggtgctcgatttagctacgctctaagggcacgaccggtgctcgatttagctacgactgcagggaacccggccaccctgaccatcagccgggtcgaagacggggatgaggccgactattactggtcaggtgtgggatagtggtagtggtgtcgtcttcggagctgggaccagggtcaccgtcctaggtcagcccaaggccaaccccactgtcactctgttcccgccctcctctctctcgactctgagcggctggcaaggcgcatagn

SEQ ID NO: 174109 - DNA, 550 bp, Homo sapiens
  misc_feature: GYAE6OF02HPPZF.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtctgggggaggcgtgttccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccgttagaagggccattcaccatctccagagacaattccaagaacaccttgcatactaacaaatgacacagtctagagacctgacggacacggctgtgtattactgtgacggaagggggagggtatttttggacgtagttcggacccgtacgttacgacttacgtcggggccgtaaccgggg

SEQ ID NO: 174110 - DNA, 254 bp, Homo sapiens; identical to SEQ ID NO: 173581
  misc_feature: GYAE6OF02GJ5JL.49.65.F10.1.454.CMB.1.raw
  modified_base (254)..(254): a, c, t, g, unknown or other
  misc_feature (254)..(254): n is a, c, g, or t

SEQ ID NO: 174111 - DNA, 257 bp, Homo sapiens
  misc_feature: GYAE6OF02FFUKX.49.65.F10.1.454.CMB.1.raw
  modified_base (229)..(229): a, c, t, g, unknown or other
  misc_feature (229)..(229): n is a, c, g, or t
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggcctcgccccctggtcactctcgtcccgcctcctctctctcgactcngagcgggctggcaaggcgcatagnnnnn

SEQ ID NO: 174112 - DNA, 255 bp, Homo sapiens
  misc_feature: GYAE6OF02HQZX6.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctccgactctgagcgggctggcaaggcgcatagnnn

SEQ ID NO: 174113 - DNA, 256 bp, Homo sapiens; identical to SEQ ID NO: 173490
  misc_feature: GYAE6OF02FQMMM.49.65.F10.1.454.CMB.1.raw
  modified_base (254)..(256): a, c, t, g, unknown or other
  misc_feature (254)..(256): n is a, c, g, or t

SEQ ID NO: 174114 - DNA, 256 bp, Homo sapiens
  misc_feature: GYAE6OF02GVFI1.49.65.F10.1.454.CMB.1.raw
  modified_base (246)..(246): a, c, t, g, unknown or other
  misc_feature (246)..(246): n is a, c, g, or t
  modified_base (252)..(256): a, c, t, g, unknown or other
  misc_feature (252)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcggctggcaaggcncatagnnnnn

SEQ ID NO: 174115 - DNA, 288 bp, Homo sapiens
  misc_feature: GYAE6OF02IUZQR.49.65.F10.1.454.CMB.1.raw
  modified_base (261)..(288): a, c, t, g, unknown or other
  misc_feature (261)..(288): n is a, c, g, or t
tcagagtcgagagacacgaccggtgctcgatttagctacgctctaagggacacggccaccctgaccatcacgcacgggtcgaagcccgggggattaggccgactattactgtcacgtgtgggacagtagtagtgatcatgtggtgttcggcggagggaccaagcttgaccgtcctaggtcaagcccaaggctgccccctggtcactctgttcccaccctcctcgtctcctcgactctgagcgggctggcaaggcgcatagnnnnnnnnnnnnnnnnnnnnnnnnnnnn

SEQ ID NO: 174116 - DNA, 285 bp, Homo sapiens
  misc_feature: GYAE6OF02I8UHC.49.65.F10.1.454.CMB.1.raw
  modified_base (248)..(248): a, c, t, g, unknown or other
  misc_feature (248)..(248): n is a, c, g, or t
  modified_base (254)..(259): a, c, t, g, unknown or other
  misc_feature (254)..(259): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(285): a, c, t, g, unknown or other
  misc_feature (271)..(285): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgattcatgtggtgttcggcggaggaccaagctgaccgtcctaggtcagcccaaggctgccccctggtcactctcgttccccacctccgtctctctcgactctgagcggctggcaggcncatagnnnnnnagntactnantnnnnnnnnnnnnnnn

SEQ ID NO: 174117 - DNA, 560 bp, Homo sapiens
  misc_feature: GYAE6OF02H7RRS.49.65.F10.1.454.CMB.1.raw
  modified_base (294)..(294): a, c, t, g, unknown or other
  misc_feature (294)..(294): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtctggggggagcgtggtccagcctgggaggtccctgagactctcctgtgaagcctctggattcaccttcaagaactttggcatgcactgggtccnccaggcctccaggcacggggctgggagtgggtggcaggttatctcagatgataggaaataaaaagtctattacggactccttagaaggccgattcaccatcctcagagacaattaccaagaactacttagactatactaacaatgacacagtctagacgacctgagacacggctgtgtattactgtggacgggaagggggtgggtattttcggacgtacgttacggaccctacgttcggactacggttacgggaccgtaaccgggg

SEQ ID NO: 174118 - DNA, 256 bp, Homo sapiens; identical to SEQ ID NO: 174005
  misc_feature: GYAE6OF02FIIMO.49.65.F10.1.454.CMB.1.raw
  modified_base (253)..(256): a, c, t, g, unknown or other
  misc_feature (253)..(256): n is a, c, g, or t

SEQ ID NO: 174119 - DNA, 257 bp, Homo sapiens; identical to SEQ ID NO: 173554
  misc_feature: GYAE6OF02FNWEC.49.65.F10.1.454.CMB.1.raw
  modified_base (253)..(257): a, c, t, g, unknown or other
  misc_feature (253)..(257): n is a, c, g, or t

SEQ ID NO: 174120 - DNA, 273 bp, Homo sapiens
  misc_feature: GYAE6OF02FVQQF.49.65.F10.1.454.CMB.1.raw
  modified_base (253)..(273): a, c, t, g, unknown or other
  misc_feature (253)..(273): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgagcgggctggcaaggcgcatagnnnnnnnnnnnnnnnnnnnnn

SEQ ID NO: 174121 - DNA, 256 bp, Homo sapiens; identical to SEQ ID NO: 173597
  misc_feature: GYAE6OF02F5G9E.49.65.F10.1.454.CMB.1.raw
  modified_base (255)..(256): a, c, t, g, unknown or other
  misc_feature (255)..(256): n is a, c, g, or t

SEQ ID NO: 174122 - DNA, 259 bp, Homo sapiens
  misc_feature: GYAE6OF02G3UK2.49.65.F10.1.454.CMB.1.raw
  modified_base (255)..(259): a, c, t, g, unknown or other
  misc_feature (255)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcgggctggcaaggcgcatagnnnnn

SEQ ID NO: 174123 - DNA, 283 bp, Homo sapiens
  misc_feature: GYAE6OF02ITQMB.49.65.F10.1.454.CMB.1.raw
  modified_base (242)..(242): a, c, t, g, unknown or other
  misc_feature (242)..(242): n is a, c, g, or t
  modified_base (264)..(283): a, c, t, g, unknown or other
  misc_feature (264)..(283): n is a, c, g, or t
tcagagtcgagagacacgaccggtgctcgatttagctacgctctaagggacgacggccgaccctgaccactcagccagggtcgaagccgggatgaggccgactattactgtcacgtgtgggacagtagtagtgatcgattggtggtgttcggcggagggtaccaaggctgaccgttcctaggtcagcccaaggctgccccctggtcactttgtcccacctccgtctctctcgactctggacncgggctggcaaggcgcatagcnnnnnnnnnnnnnnnnnnnn

SEQ ID NO: 174124 - DNA, 295 bp, Homo sapiens
  misc_feature: GYAE6OF02G60FC.49.65.F10.1.454.CMB.1.raw
  modified_base (259)..(295): a, c, t, g, unknown or other
  misc_feature (259)..(295): n is a, c, g, or t
tcagagtcgagagacacgaccggtgctcgatttagctacgctctaagggacgacggaccaccctgaccatcagcagggtcgaagccggggatgaggccgactattactgtcacgtgtgggacagtagtagtgatcatgtggtgttcggcggagggaccaagcttgaccgtcctaggtcagcccaaggctgccccctggtcactctgttcccacccgtctctcgtctcgactctgacgcgggctggcaaggcgtcatagnnnnnnnnnnnnnnnnnnnnnnnnnnnnnnnnnnnnn

SEQ ID NO: 174125 - DNA, 261 bp, Homo sapiens
  misc_feature: GYAE6OF02F0X95.49.65.F10.1.454.CMB.1.raw
  modified_base (254)..(261): a, c, t, g, unknown or other
  misc_feature (254)..(261): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnn

SEQ ID NO: 174126 - DNA, 258 bp, Homo sapiens; identical to SEQ ID NO: 173614
  misc_feature: GYAE6OF02F5XJC.49.65.F10.1.454.CMB.1.raw
  modified_base (254)..(258): a, c, t, g, unknown or other
  misc_feature (254)..(258): n is a, c, g, or t

SEQ ID NO: 174127 - DNA, 260 bp, Homo sapiens
  misc_feature: GYAE6OF02F7TT0.49.65.F10.1.454.CMB.1.raw
  modified_base (255)..(260): a, c, t, g, unknown or other
  misc_feature (255)..(260): n is a, c, g, or t
tcagagtcgagagacacgaccggtgctcgatttagctacgctctaagggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctcctctcgactctgagcgggctggcaaggcgcatagnnnnnn

SEQ ID NO: 174128 - DNA, 259 bp, Homo sapiens
  misc_feature: GYAE6OF02FGJ17.49.65.F10.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccacctcctctctctcgactctgagcgggctggcaaggcgcatagnnnnnnn

SEQ ID NO: 174129 - DNA, 260 bp, Homo sapiens
  misc_feature: GYAE6OF02HCHT1.49.65.F10.1.454.CMB.1.raw
  modified_base (254)..(260): a, c, t, g, unknown or other
  misc_feature (254)..(260): n is a, c, g, or t
tcagagtcgagagacacgaccggtgctcgatttagctacgctctaaggacgacggccaccctgaccatcagcagggtcgaagccgggatgaggccgactattactgtcacgtgtggacagtagtagtgatcatgtggtgttcggcggagggaccaagctgaccgtcctaggtcacgcccaaggctcgccccctcggtcactctcgttcccaccctcctctctctcgactctgacgcggctggcaaggcgcatgnnnnnnn

SEQ ID NO: 174130 - DNA, 256 bp, Homo sapiens; identical to SEQ ID NO: 173564
  misc_feature: GYAE6OF02IM0GT.49.65.F10.1.454.CMB.1.raw
  modified_base (253)..(256): a, c, t, g, unknown or other
  misc_feature (253)..(256): n is a, c, g, or t

SEQ ID NO: 174131 - DNA, 255 bp, Homo sapiens
  misc_feature: GYAE6OF02G1KXQ.49.65.F10.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgagcgggctggcaaggcgcatagnnnn

SEQ ID NO: 174132 - DNA, 282 bp, Homo sapiens
  misc_feature: GYAE6OF02HNCKJ.49.65.F10.1.454.CMB.1.raw
  modified_base (256)..(260): a, c, t, g, unknown or other
  misc_feature (256)..(260): n is a, c, g, or t
  modified_base (262)..(282): a, c, t, g, unknown or other
  misc_feature (262)..(282): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctgttccccgccctcctctctctcgactctgagcgggctgggcaaggcgcatagnnnnngnnnnnnnnnnnnnnnnnnnnn

SEQ ID NO: 174133 - DNA, 257 bp, Homo sapiens; identical to SEQ ID NO: 173521
  misc_feature: GYAE6OF02GQO5H.49.65.F10.1.454.CMB.1.raw
  modified_base (254)..(257): a, c, t, g, unknown or other
  misc_feature (254)..(257): n is a, c, g, or t

SEQ ID NO: 174134 - DNA, 713 bp, Homo sapiens
  misc_feature: GYAE6OF02II1O7.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgaagcctctggattcaccttcaagaactttggcatgcacgtgggtccgccaggctccaggcgacggggctgggagtcgggtggcagttatctcagatgataggaaagtaaaagtactattacggacttccgttaggaacgggtccgtaattccaacctacttcctaccaagaacgaacctaaactttacccaaaggtaaacctaacccgtttacgacctaacgttaccttaaacctaaaacttcggaaccctaaacgtacggtaccttaggaaccgtaacccgtacggaacgggaaccgaccgggtcttaggtacgttaacgttacgtgggtacggacggggtaagggggggtaacggggttaagtttttcggaaccgttaacggttaccgggtaacccccgttaacggttttaccggtaacccgtttaaccgggttaccgggggtaaccccggtaaacccggggg

SEQ ID NO: 174135 - DNA, 258 bp, Homo sapiens
  misc_feature: GYAE6OF02GPHMO.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcggctggcaaggcgcatagnnnnnn

SEQ ID NO: 174136 - DNA, 255 bp, Homo sapiens; identical to SEQ ID NO: 173465
  misc_feature: GYAE6OF02FPM3V.49.65.F10.1.454.CMB.1.raw
  modified_base (254)..(255): a, c, t, g, unknown or other
  misc_feature (254)..(255): n is a, c, g, or t

SEQ ID NO: 174137 - DNA, 259 bp, Homo sapiens; identical to SEQ ID NO: 173645
  misc_feature: GYAE6OF02JJH4T.49.65.F10.1.454.CMB.1.raw
  modified_base (253)..(259): a, c, t, g, unknown or other
  misc_feature (253)..(259): n is a, c, g, or t

SEQ ID NO: 174138 - DNA, 257 bp, Homo sapiens; identical to SEQ ID NO: 173554
  misc_feature: GYAE6OF02HYGJ9.49.65.F10.1.454.CMB.1.raw
  modified_base (253)..(257): a, c, t, g, unknown or other
  misc_feature (253)..(257): n is a, c, g, or t

SEQ ID NO: 174139 - DNA, 290 bp, Homo sapiens
  misc_feature: GYAE6OF02GV0DN.49.65.F10.1.454.CMB.1.raw
  modified_base (255)..(290): a, c, t, g, unknown or other
  misc_feature (255)..(290): n is a, c, g, or t
tcagagtcgagagacacgaccggtgctcgatttagctacgctctaagggacacggccaccctgaccatcagcagggtcgaagccggggatgaggccgactattactagtcacgtgtgggacagtagtagtgatcatgtggtgttcggcggagggaccaagctgaccgtcctaggtcagcccaaggctgccccctggtcactctgttcccacccgtcctctctctcgactctgagcggctggcaaggcgcatacgnnnnnnnnnnnnnnnnnnnnnnnnnnnnnnnnnnnn

SEQ ID NO: 174140 - DNA, 541 bp, Homo sapiens
  misc_feature: GYAE6OF02JFVZP.49.65.F10.1.454.CMB.1.raw
  modified_base (332)..(332): a, c, t, g, unknown or other
  misc_feature (332)..(332): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (462)..(462): a, c, t, g, unknown or other
  misc_feature (462)..(462): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagtaactttggcatcgcactgggtccgcaggctccaggcacgggctggagtgggtggcagttanctcagatgagtggaaagtaaaagtactatcggactcctgaaggcatcacntcncaganacaatcaagacactnacatctaacaatcacacagtctagacacctagacgacgacggtctgtagtattacgngtcgacggaagggggaggttagttttggacttagttaccggaccctagttacggactacggtcggggacctaaccgggg

SEQ ID NO: 174141 - DNA, 264 bp, Homo sapiens
  misc_feature: GYAE6OF02IHOPC.49.65.F10.1.454.CMB.1.raw
  modified_base (256)..(264): a, c, t, g, unknown or other
  misc_feature (256)..(264): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgacgcgggctggcaaggcgcatagnnnnnnnnn

SEQ ID NO: 174142 - DNA, 354 bp, Homo sapiens
  misc_feature: GYAE6OF02JLUZH.49.65.F10.1.454.CMB.1.raw
  modified_base (302)..(303): a, c, t, g, unknown or other
  misc_feature (302)..(303): n is a, c, g, or t
  modified_base (306)..(306): a, c, t, g, unknown or other
  misc_feature (306)..(306): n is a, c, g, or t
  modified_base (309)..(310): a, c, t, g, unknown or other
  misc_feature (309)..(310): n is a, c, g, or t
  modified_base (315)..(318): a, c, t, g, unknown or other
  misc_feature (315)..(318): n is a, c, g, or t
  modified_base (320)..(321): a, c, t, g, unknown or other
  misc_feature (320)..(321): n is a, c, g, or t
  modified_base (324)..(328): a, c, t, g, unknown or other
  misc_feature (324)..(328): n is a, c, g, or t
  modified_base (330)..(354): a, c, t, g, unknown or other
  misc_feature (330)..(354): n is a, c, g, or t
tcagagtcgagagacacgaccggtgctcgatttagctacgctctaagggtcgacgaccgggtgctcgactttacgctacgctctaggggacacggtccaccctgaccatcagcagggtcgaagccggggatgaggccgactattactgtcacgtgtgggactaggtagtagtgattcatgtggtgttcggcggaggaccaagctgaccgtcctaggtcagcccaaggctcgcccccgtgggtcacgtctcgttcccgccctctctactcgtcactctgcgcggctggacacggcgcatagcnnctngcnncgagnnnntnntannnnncnnnnnnnnnnnnnnnnnnnnnnnnn

SEQ ID NO: 174143 - DNA, 262 bp, Homo sapiens
  misc_feature: GYAE6OF02G3001.49.65.F10.1.454.CMB.1.raw
  modified_base (255)..(262): a, c, t, g, unknown or other
  misc_feature (255)..(262): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccgccctcctctctctcgactctgagcgggctggcaaggcgcatagnnnnnnnn

SEQ ID NO: 174144 - DNA, 297 bp, Homo sapiens
  misc_feature: GYAE6OF02HJLEL.49.65.F10.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (253)..(254): a, c, t, g, unknown or other
  misc_feature (253)..(254): n is a, c, g, or t
  modified_base (260)..(260): a, c, t, g, unknown or other
  misc_feature (260)..(260): n is a, c, g, or t
  modified_base (262)..(297): a, c, t, g, unknown or other
  misc_feature (262)..(297): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctggcactcngttcccgccctctctctctcgactctgagcggctggcaggcncatgntnntgatcnannnnnnnnnnnnnnnnnnnnnnnnnnnnnnnnnnnn

SEQ ID NO: 174145 - DNA, 310 bp, Homo sapiens
  misc_feature: GYAE6OF02GJ91K.49.65.F10.1.454.CMB.1.raw
  modified_base (288)..(310): a, c, t, g, unknown or other
  misc_feature (288)..(310): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccacctcctctctctcgactctgagcgggctggcaaggcgcatagnnnnnnnnnnnnnnnnnnnnnnn

SEQ ID NO: 174146 - DNA, 258 bp, Homo sapiens; identical to SEQ ID NO: 173560
  misc_feature: GYAE6OF02FZBJL.49.65.F10.1.454.CMB.1.raw
  modified_base (254)..(258): a, c, t, g, unknown or other
  misc_feature (254)..(258): n is a, c, g, or t

SEQ ID NO: 174147 - DNA, 598 bp, Homo sapiens
  misc_feature: GYAE6OF02IKNIS.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtctgggggaggcgtggtccagcctgggaggtccctgagactctcctgtgagcctctggattcaccttcaagaactttggcatgcactgggtccgccaggcctccgaggcacgggggctgggagtgggtggcagttatctcagtatgagtaggaaagtaaaaagtctaattcggactccttaggaacgggccgattccaccatctaccagagacaattaccaagtaaccaccttgactatctaacaatcgacacagtctagaacgacctaggaggaccacgggtctggtagttacttacgtggtagacggggaagggggtacgggttagtttttcggacgttagttaccggtacccgtacgtttacgaccggttacggtacggggacccggtaaccgggg

SEQ ID NO: 174148 - DNA, 256 bp, Homo sapiens; identical to SEQ ID NO: 173670
  misc_feature: GYAE6OF02FYPTM.49.65.F10.1.454.CMB.1.raw
  modified_base (255)..(256): a, c, t, g, unknown or other
  misc_feature (255)..(256): n is a, c, g, or t

SEQ ID NO: 174149 - DNA, 265 bp, Homo sapiens
  misc_feature: GYAE6OF02IZP06.49.65.F10.1.454.CMB.1.raw
  modified_base (256)..(265): a, c, t, g, unknown or other
  misc_feature (256)..(265): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcccaaccccactgtcactctgttcccaccctcctctctctcgactctgagcgggctggcaaggcgcatagnnnnnnnnnn

SEQ ID NO: 174150 - DNA, 303 bp, Homo sapiens
  misc_feature: GYAE6OF02G96KE.49.65.F10.1.454.CMB.1.raw
  modified_base (265)..(265): a, c, t, g, unknown or other
  misc_feature (265)..(265): n is a, c, g, or t
  modified_base (271)..(303): a, c, t, g, unknown or other
  misc_feature (271)..(303): n is a, c, g, or t
tcagagtcgagagacacgaccggtgctcgatttagctacgctctaaggggacacgggccaccctgaccatcagcagggtcgaagccgggggatgaggccgactattactgtcacgtgtgggacacgtagtacgtgatccatgtggtgttcggcggagggaccaaggctggacccgtcctaggtcagcccaaggcctgcccccctcggtccactctgttccccgccctccctctctcgtcgactctgagcgggtctgggcaaggcncatagnnnnnnnnnnnnnnnnnnnnnnnnnnnnnnnnn

SEQ ID NO: 174151 - DNA, 295 bp, Homo sapiens
  misc_feature: GYAE6OF02GX3JZ.49.65.F10.1.454.CMB.1.raw
  modified_base (288)..(295): a, c, t, g, unknown or other
  misc_feature (288)..(295): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgcctcctctctctcgactctgagcgggctggcaaggcgcatagnnnnnnnn

SEQ ID NO: 174152 - DNA, 565 bp, Homo sapiens
  misc_feature: GYAE6OF02GI5NT.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtgttccagcctgggagtccctgagactctcctgtgaagcctctggattcaccttcaagtaactttggcatgcactgggtccgccaggctccgaggcacggggctggagtgggtgcagttatctcagatgataggaaagtaaaagtctaagttcggactcgttaggaagggcctattcacctatcctcagagacaattccaagaacacctgacatactaacaatgacacatcgtagacgacgtgacgacgacggtctgtagttattacgtgtcgacgggtaagggggtagggtagttttggacgttagttcggtaccgtacgttacgaccgttacggtcggggaccgtaaccgggg

SEQ ID NO: 174153 - DNA, 255 bp, Homo sapiens; identical to SEQ ID NO: 174131
  misc_feature: GYAE6OF02F4HIF.49.65.F10.1.454.CMB.1.raw
  modified_base (252)..(255): a, c, t, g, unknown or other
  misc_feature (252)..(255): n is a, c, g, or t

SEQ ID NO: 174154 - DNA, 255 bp, Homo sapiens; identical to SEQ ID NO: 173485
  misc_feature: GYAE6OF02HMYBG.49.65.F10.1.454.CMB.1.raw
  modified_base (253)..(255): a, c, t, g, unknown or other
  misc_feature (253)..(255): n is a, c, g, or t

SEQ ID NO: 174155 - DNA, 257 bp, Homo sapiens; identical to SEQ ID NO: 173609
  misc_feature: GYAE6OF02FL7JJ.49.65.F10.1.454.CMB.1.raw
  modified_base (254)..(257): a, c, t, g, unknown or other
  misc_feature (254)..(257): n is a, c, g, or t

SEQ ID NO: 174156 - DNA, 259 bp, Homo sapiens
  misc_feature: GYAE6OF02IJQ83.49.65.F10.1.454.CMB.1.raw
  modified_base (255)..(259): a, c, t, g, unknown or other
  misc_feature (255)..(259): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnnnn

SEQ ID NO: 174157 - DNA, 815 bp, Homo sapiens
  misc_feature: GYAE6OF02I0JSH.49.65.F10.1.454.CMB.1.raw
  modified_base (167)..(167): a, c, t, g, unknown or other
  misc_feature (167)..(167): n is a, c, g, or t
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcggtgttcgctaggctcttaagaggtntcagtgtcagtgcagctggtgagtctggggagcgtgccagcctggagtccctgganactctccctgagaagcctctggtcttacgcccgtttanaagttactttcggactagtcgtaccgtacggttccggggtcccgaccgtacgggtccgtacccggacgggtccgggaccggggtacgtggggtaggttcggggtacggtgtaaccgtttacgtccgtacgtagtagtacggtaagtaagggtaaaacgttaaaacgttacgtttaacggttaacggtaaccgttaaccggttaagggtaaccgggtacccgttaagtttacccgacccgttaattccctaaaccggaaacgtaaccggtaaacttaaaccgtttaaacccggtaaaacgtaacccgttacccgtacgtaaaccctaacgttaaccgttaaactaacgtactaccgtaaccgtaacgtaccgtaccgtacgtaccgtaacggtaacggaaccggtaccgtaccgttacgttacgttacgttacgttacggtacgggtacgggtaacggggttaagggtttacggtttacggttaccggttacggttaccggttaacccgttacggttaccgtaacggtaaccgggtaccgggtaccggtaaccgg

SEQ ID NO: 174158 - DNA, 593 bp, Homo sapiens
  misc_feature: GYAE6OF02GJF1Y.49.65.F10.1.454.CMB.1.raw
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
  modified_base (491)..(491): a, c, t, g, unknown or other
  misc_feature (491)..(491): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggaggcgtggtccagcctggggaggtccctgagactctcctgtgaagcctctggattccaccttcaaagtaactttggactatgcacgtcggggtcccgccaggctccgagggcgacgggggctgggaggtggggtggctaggttatcgtcaggatgagtaggaaagtaaaagtctagttacgactcctaggaacggcgattcacntccacagacgacaactaccaagactaccttnacatactaacaaatcgacacgagtcgtagacgaccgtaggagaccacggntagtacgtagttacgtggtaggacgggaaggggggtgggttagtttggacgtagttccggacccgtacgtacgtaacggtcgtcgggggaccctaaccgggg

SEQ ID NO: 174159 - DNA, 687 bp, Homo sapiens
  misc_feature: GYAE6OF02IDGME.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgaacgcctctggattcaccttcaagtaactttggcatgcacgtgggtcccgccgaggcctccgagggccgacgggggctggggaggtggggtggctaggttatctcgagtatgaatagggaaagtaaaaagtactaagtttccggtaacttccgttagggaaacgggcccgtaattccgaaccctacttcctaccgaaggaacgtaacctaaactttacccgaaacggtaaacctacccttaggacctaataccgttaaactaaatcgaccaactacgtctacgaacgtacctaggaacggacctacgggtcttggttacttagtttaacgtggttacgggtacggggtaagggggggtagggtttaacgtttttcgggacgttaggttaccggtacccttagttcggtaacgttacggtaccgggggaccctaacggggg

SEQ ID NO: 174160 - DNA, 265 bp, Homo sapiens
  misc_feature: GYAE6OF02GGJUQ.49.65.F10.1.454.CMB.1.raw
  modified_base (254)..(265): a, c, t, g, unknown or other
  misc_feature (254)..(265): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgacgcggctggcaaggcgcatagnnnnnnnnnnnn

SEQ ID NO: 174161 - DNA, 255 bp, Homo sapiens; identical to SEQ ID NO: 173574
  misc_feature: GYAE6OF02IP57Q.49.65.F10.1.454.CMB.1.raw
  modified_base (253)..(255): a, c, t, g, unknown or other
  misc_feature (253)..(255): n is a, c, g, or t

SEQ ID NO: 174162 - DNA, 262 bp, Homo sapiens
  misc_feature: GYAE6OF02H75RL.49.65.F10.1.454.CMB.1.raw
  modified_base (253)..(262): a, c, t, g, unknown or other
  misc_feature (253)..(262): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnnnnnnnn

SEQ ID NO: 174163 - DNA, 287 bp, Homo sapiens
  misc_feature: GYAE6OF02FS2JZ.49.65.F10.1.454.CMB.1.raw
  modified_base (251)..(251): a, c, t, g, unknown or other
  misc_feature (251)..(251): n is a, c, g, or t
  modified_base (257)..(287): a, c, t, g, unknown or other
  misc_feature (257)..(287): n is a, c, g, or t
tcagagtcgagagacacgaccggtgctcgatttagctacgctctaagggacgacggccaccctgaccatcagcagggtcgaaagccggggatgaggccgactattactgtcacgtgtgggacagtagtagtgatcatgtgggtgttcggcggagggaccaagctgaccgtcctaggtcagcccaaggctgccccctggtcactctgttcccacctcctctcgtctcgactctgagcgggctggcaaggccncatagnnnnnnnnnnnnnnnnnnnnnnnnnnnnnnn

SEQ ID NO: 174164 - DNA, 258 bp, Homo sapiens; identical to SEQ ID NO: 173614
  misc_feature: GYAE6OF02F0HVN.49.65.F10.1.454.CMB.1.raw
  modified_base (254)..(258): a, c, t, g, unknown or other
  misc_feature (254)..(258): n is a, c, g, or t

SEQ ID NO: 174165 - DNA, 319 bp, Homo sapiens
  misc_feature: GYAE6OF02J2VQW.49.65.F10.1.454.CMB.1.raw
  modified_base (144)..(144): a, c, t, g, unknown or other
  misc_feature (144)..(144): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (269)..(271): a, c, t, g, unknown or other
  misc_feature (269)..(271): n is a, c, g, or t
  modified_base (274)..(274): a, c, t, g, unknown or other
  misc_feature (274)..(274): n is a, c, g, or t
  modified_base (283)..(319): a, c, t, g, unknown or other
  misc_feature (283)..(319): n is a, c, g, or t
tcagagtcgagagacacgaccggtgctcgatttagctacgctctaaggggtacgacggccaccctgaccatcagcagggtcgaagccggggatgaggccgactattactgtcacgtgtgggacagtagtagtgatcatgtggtnttcggcgagggaccaagctgaccgtctagtcagcccaaggctgccccctggtcactctcgttccccaccttctctctctacgactctggacgtccgggtntagggctaagggccncagtagcagnnnaangctgcatgnnnnnnnnnnnnnnnnnnnnnnnnnnnnnnnnnnnnn

SEQ ID NO: 174166 - DNA, 257 bp, Homo sapiens; identical to SEQ ID NO: 173609
  misc_feature: GYAE6OF02FXLSF.49.65.F10.1.454.CMB.1.raw
  modified_base (254)..(257): a, c, t, g, unknown or other
  misc_feature (254)..(257): n is a, c, g, or t

SEQ ID NO: 174167 - DNA, 753 bp, Homo sapiens
  misc_feature: GYAE6OF02H6A7S.49.65.F10.1.454.CMB.1.raw
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtgttccagcctgggaggtccctgagactctcctgtgaagcctctggattcaccttnaaagtaactttggcatgcacgtgggtccnccaggcctccgaggccgacggggctggagtggggtgctagttatctcgagatggaatagggtaaaagttaaaaggtacttaagttaccggtacttccgtttagggaaaacgggtcccgtaatttcccgaaccgtacgttcccgtacccgaacggtaacgtaaaccgtaaacgttaacccgaaaacgtaaacctaacccgttacgactaacttacctaaactaaactacgacctaacgtacgtaccgtacgaacgtaaccgtacgaacggtaacgtaaccgggtacgttacggttacgttaacgtttacgttaggttacgggtacggggtaaagggggggtacggggtttaagttttttacgggaccgtttaacggtttaccgggtaaccccgtaacggtttaccggttaacccggtttaaccgggttacccgggggtacccggttaaacccgggggg

SEQ ID NO: 174168 - DNA, 261 bp, Homo sapiens
  misc_feature: GYAE6OF02IVACE.49.65.F10.1.454.CMB.1.raw
  modified_base (253)..(261): a, c, t, g, unknown or other
  misc_feature (253)..(261): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnn

SEQ ID NO: 174169 - DNA, 260 bp, Homo sapiens
  misc_feature: GYAE6OF02I7BV9.49.65.F10.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgctctaagggacacggccaccctgaccatcagcagggtcgaagccggggatgaggccgactattactgtcacgtgtggacagtagtagtgatcatgtggtgttcggcggagggaccaagctgaccgtcctaggtcagcccaaggctgccccctggtcactctgttcccaccctctctctctcgactctgagcgggctggcaaggcgcatagnnnnnnnnnn

SEQ ID NO: 174170 - DNA, 600 bp, Homo sapiens
  misc_feature: GYAE6OF02F69XW.49.65.F10.1.454.CMB.1.raw
  modified_base (331)..(331): a, c, t, g, unknown or other
  misc_feature (331)..(331): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagttttggctgagctgggttttcctcgttgctcttttaagaggtgtccagtgtcaggtgcagctggtggagtctgggggaggcgtggtccagcctgggagtccctgagactctcctgtgaagcctctggattcaccttcaagtaactttggctatgcacgtcgggtccgccaggcctccgaggccgacggggctgggagtgggnggctagttatctcagatgataggaaagtaaaagtactagttcgacttccgtaggaaggcctattcaccatcctacaagtacgacaacgttaccaaagtaacctacttgacctaattacctaaacaatcgaccaactagtactagacgactggaacggacacggcttgacgtttatacgtggtcggacgggtaaggggggtcggtttaattttggacgttagttaccggaccctagttaccggaacgtcgggtcgggacccgtaaccggg

SEQ ID NO: 174171 - DNA, 307 bp, Homo sapiens
  misc_feature: GYAE6OF02IWASF.49.65.F10.1.454.CMB.1.raw
  modified_base (267)..(307): a, c, t, g, unknown or other
  misc_feature (267)..(307): n is a, c, g, or t
tcagagtcgagagacacgaccggtgctcgatttagctacgctctaagggacgacggccaccctgaccactcaggcagggtcgaagccgggggatgaggccgactattactgtcacgtgtgggacagtagtagtgatcgatggtggtgttcggcggtagggtaccaagctgaccgttcctaggtcagcccaaggctgccccctggtcacgtctgttccccgaccgtcctctctctcgactcgtgagcgggctcggcaaggcgcatagnnnnnnnnnnnnnnnnnnnnnnnnnnnnnnnnnnnnnnnnn

SEQ ID NO: 174172 - DNA, 254 bp, Homo sapiens
  misc_feature: GYAE6OF02FN2N6.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgcctcctctctctcgactctgagcgggctggcaaggcgcatagnn

SEQ ID NO: 174173 - DNA, 265 bp, Homo sapiens
  misc_feature: GYAE6OF02IWZ4Z.49.65.F10.1.454.CMB.1.raw
  modified_base (256)..(265): a, c, t, g, unknown or other
  misc_feature (256)..(265): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctggtcactctcgttcccaccctcctctctctcgactctgagcgggctggcaaggcgacatagnnnnnnnnnn

SEQ ID NO: 174174 - DNA, 258 bp, Homo sapiens; identical to SEQ ID NO: 173809
  misc_feature: GYAE6OF02GAUBK.49.65.F10.1.454.CMB.1.raw
  modified_base (253)..(258): a, c, t, g, unknown or other
  misc_feature (253)..(258): n is a, c, g, or t

SEQ ID NO: 174175 - DNA, 256 bp, Homo sapiens
  misc_feature: GYAE6OF02GW5DW.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgagcgggctggcaaggcgcatagnn

SEQ ID NO: 174176 - DNA, 257 bp, Homo sapiens; identical to SEQ ID NO: 173534
  misc_feature: GYAE6OF02G08WF.49.65.F10.1.454.CMB.1.raw
  modified_base (254)..(257): a, c, t, g, unknown or other
  misc_feature (254)..(257): n is a, c, g, or t

SEQ ID NO: 174177 - DNA, 665 bp, Homo sapiens
  misc_feature: GYAE6OF02I2RKY.49.65.F10.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (172)..(174): a, c, t, g, unknown or other
  misc_feature (172)..(174): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagcggcgttcgctagcgtcttatagncagntcngnnngctgngngntgggagcgtgccaggctgggngtcctgcgctctcgtgcganccctntcgacttcgaaccttcgaagtaacctttggcagtcgccncgttggggtcccnctacggtcgaccgnggacgtccggggtcgtaggtacgggttcgggtacggactaggtttactcgaccgagtatggtaagttaggtaaaagttaaaactcttagtcggaacttcgtagggacgctacttcacgtactcgaccgtaacacgaactaacgtacgaacgtaaacttcgtactactaacttacgtaactaaacgtacgacctactacgtacgtacgtacgtaccgtacggtaacggtaccggaccgtaccgttcggttacgttaacgttacggtaggtacggtaacgggtaacggggttacgggtttacggtttacggtacgttacgtaccggtaccgtaccgttacgtaccggtccggttaccgggtacggtaccggg

SEQ ID NO: 174178 - DNA, 258 bp, Homo sapiens
  misc_feature: GYAE6OF02FULDV.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgagcgggctggcaaggcgcatagnnnnnn

SEQ ID NO: 174179 - DNA, 259 bp, Homo sapiens
  misc_feature: GYAE6OF02HMAA3.49.65.F10.1.454.CMB.1.raw
  modified_base (256)..(259): a, c, t, g, unknown or other
  misc_feature (256)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctgggacaaggcgcatagnnnn

SEQ ID NO: 174180 - DNA, 365 bp, Homo sapiens
  misc_feature: GYAE6OF02I9K57.49.65.F10.1.454.CMB.1.raw
  modified_base (84)..(84): a, c, t, g, unknown or other
  misc_feature (84)..(84): n is a, c, g, or t
  modified_base (268)..(272): a, c, t, g, unknown or other
  misc_feature (268)..(272): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (296)..(365): a, c, t, g, unknown or other
  misc_feature (296)..(365): n is a, c, g, or t
tcagagtcgagagacacgaccggtgctcgattttagctacgctctaagggacgacggccaccctgaccatcagcagggtcgaanccggggatgaggccgactattactgtccacgtgtggacagtagtagtgatcatgtggtgtttcggcgggaggacctaagctgaccgtcctaggtcagcccaaggctgcccccctggtccacgtctgttccccacccttcctctctcctcgacctctggacgcgggctggacaaggcctcatagnnnnntgnacgcancgngngntcntgcannnnnnnnnnnnnnnnnnnnnnnnnnnnnnnnnnnnnnnnnnnnnnnnnnnnnnnnnnnnnnnnnnnnnn

SEQ ID NO: 174181 - DNA, 783 bp, Homo sapiens
  misc_feature: GYAE6OF02FNMF7.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctgggaggtgggtggcagttatctcgagatgataggaaagttaaaaagtacttaattccgggaacttcccgttagggaaaggggtccccgaagtttcccaaccctaattcccgtaccctaaggaacgtaaaccgaaactttacccgaaaacggtaaaccaaacccgtttacggaccctaacttaccttaaacctaaaacgttacggaacctaaccgacggttaccttacggaacggtaacccgttaggaaccggggtaaccaccggggtaccttagggttacgttaagttttaccgtagggtttacgggacgggggtaaacgggggggggttaacgggggggtttaaggttttttttaccggggtaccggttaacgttttaccgggggtaaccccccgtttaaccggttttaccggtaaccggttttaaccggtttaccggggggggtaccccgttaaaccccgggggggg

SEQ ID NO: 174182 - DNA, 293 bp, Homo sapiens
  misc_feature: GYAE6OF02GBWR7.49.65.F10.1.454.CMB.1.raw
  modified_base (252)..(252): a, c, t, g, unknown or other
  misc_feature (252)..(252): n is a, c, g, or t
  modified_base (259)..(261): a, c, t, g, unknown or other
  misc_feature (259)..(261): n is a, c, g, or t
  modified_base (263)..(293): a, c, t, g, unknown or other
  misc_feature (263)..(293): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctggtcactctcgttccccaccctcctctctctcgactctgagcggctggacaaggcncagtagnnnannnnnnnnnnnnnnnnnnnnnnnnnnnnnnn

SEQ ID NO: 174183 - DNA, 257 bp, Homo sapiens
  misc_feature: GYAE6OF02G5MTO.49.65.F10.1.454.CMB.1.raw
  modified_base (248)..(248): a, c, t, g, unknown or other
  misc_feature (248)..(248): n is a, c, g, or t
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcncatagnnnn

SEQ ID NO: 174184 - DNA, 255 bp, Homo sapiens; identical to SEQ ID NO: 173485
  misc_feature: GYAE6OF02FX0U4.49.65.F10.1.454.CMB.1.raw
  modified_base (253)..(255): a, c, t, g, unknown or other
  misc_feature (253)..(255): n is a, c, g, or t

SEQ ID NO: 174185 - DNA, 257 bp, Homo sapiens; identical to SEQ ID NO: 173529
  misc_feature: GYAE6OF02FH6ZP.49.65.F10.1.454.CMB.1.raw
  modified_base (253)..(257): a, c, t, g, unknown or other
  misc_feature (253)..(257): n is a, c, g, or t

SEQ ID NO: 174186 - DNA, 543 bp, Homo sapiens
  misc_feature: GYAE6OF02FXKSQ.49.65.F10.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (412)..(413): a, c, t, g, unknown or other
  misc_feature (412)..(413): n is a, c, g, or t
  modified_base (416)..(416): a, c, t, g, unknown or other
  misc_feature (416)..(416): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgaagccctntggattcaccttcaagtaactttggcatgcactgggtcccncaggctccgaggcacggggctgggagtgggngcagttatctnagatgataggaaagtaaaagtctatcgactcgtagaggcatcacatcncaganacatcaanacactnacatcacanncanagtctagacgaccgtgacgacgacggtctgtacgtattacgtgtcggacggtaagggggtagggttagttttggacgttacgtttcggaccctacgttacgacgttacggtcgggaccgtaaccggg

SEQ ID NO: 174187 - DNA, 260 bp, Homo sapiens
  misc_feature: GYAE6OF02H38PM.49.65.F10.1.454.CMB.1.raw
  modified_base (248)..(248): a, c, t, g, unknown or other
  misc_feature (248)..(248): n is a, c, g, or t
  modified_base (254)..(260): a, c, t, g, unknown or other
  misc_feature (254)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcncatagnnnnnnn

SEQ ID NO: 174188 - DNA, 270 bp, Homo sapiens
  misc_feature: GYAE6OF02FJ30T.49.65.F10.1.454.CMB.1.raw
  modified_base (253)..(270): a, c, t, g, unknown or other
  misc_feature (253)..(270): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctggtcactctgttccccgcctcctctctctcgactctgagcgggctggcaaggcgcatagnnnnnnnnnnnnnnnnnn

SEQ ID NO: 174189 - DNA, 271 bp, Homo sapiens
  misc_feature: GYAE6OF02IFMQT.49.65.F10.1.454.CMB.1.raw
  modified_base (256)..(271): a, c, t, g, unknown or other
  misc_feature (256)..(271): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcgggctggccaaggcgcatagnnnnnnnnnnnnnnnn

SEQ ID NO: 174190 - DNA, 593 bp, Homo sapiens
  misc_feature: GYAE6OF02HM4EL.49.65.F10.1.454.CMB.1.raw
  modified_base (409)..(409): a, c, t, g, unknown or other
  misc_feature (409)..(409): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtgttccagcctgggaggtccctgagactctcctgtgaacgcctcgtggtattccaccttcaaagtaactttggcatgcacgtgggtcccgccaggcctccgaggcgacgggggctgggagtggggtggctaggttatctacgagatgatagggaaagtaaaagtctatcggactcgtagaaggcatcacatcacaganactaatcaagaactacttgactatactaacaatcgacacagtctagacgtactaggacgacgacggcttggtacgttattacgtggtaggacgggtaaggggggtagggttagtttttacggacttaggttccggtacccttacgttacgtaaccggtacggttccggggaccgtaacccgggg

SEQ ID NO: 174191 - DNA, 296 bp, Homo sapiens
  misc_feature: GYAE6OF02IPP45.49.65.F10.1.454.CMB.1.raw
  modified_base (290)..(293): a, c, t, g, unknown or other
  misc_feature (290)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcgggctggcaaggcgcatagnnnnttt

SEQ ID NO: 174192 - DNA, 267 bp, Homo sapiens
  misc_feature: GYAE6OF02JOAJN.49.65.F10.1.454.CMB.1.raw
  modified_base (253)..(267): a, c, t, g, unknown or other
  misc_feature (253)..(267): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcggctggcaaggcgcatagnnnnnnnnnnnnnnn

SEQ ID NO: 174193 - DNA, 256 bp, Homo sapiens
  misc_feature: GYAE6OF02FXQLA.49.65.F10.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcggctggcaaggcgcatagnnnnn

SEQ ID NO: 174194 - DNA, 300 bp, Homo sapiens
  misc_feature: GYAE6OF02GXENQ.49.65.F10.1.454.CMB.1.raw
  modified_base (291)..(300): a, c, t, g, unknown or other
  misc_feature (291)..(300): n is a, c, g, or t
tcagagtcgagagacacgaccggtgctcgatttagctacgctctaagggcacgaccggtgctcgatttagctacgctctagggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccctcggtcactctcgttcccaccctcctctctctcgactctgagcggtctggcaaggcgcatagnnnnnnnnnn

SEQ ID NO: 174195 - DNA, 332 bp, Homo sapiens
  misc_feature: GYAE6OF02IDZ2O.49.65.F10.1.454.CMB.1.raw
  modified_base (266)..(332): a, c, t, g, unknown or other
  misc_feature (266)..(332): n is a, c, g, or t
tcagagtcgagagacacgaccggtgctcgatttagctacgctctaaggggacgacgggccaccctgaccatcagcagggtcgaagccggggatgaggccgactattactgtcacgtgtgggacagtagtagtgatcatggtggtgttcggcggagggaccaagctgaccgtcctaggtcagcccaaggctgcccccctggtcactctgttccccaccctctctctctcgactctggacggcgggctggacaaggtcgcaagtacgnnnnnnnnnnnnnnnnnnnnnnnnnnnnnnnnnnnnnnnnnnnnnnnnnnnnnnnnnnnnnnnnnnn

SEQ ID NO: 174196 - DNA, 296 bp, Homo sapiens
  misc_feature: GYAE6OF02F1U9F.49.65.F10.1.454.CMB.1.raw
  modified_base (290)..(296): a, c, t, g, unknown or other
  misc_feature (290)..(296): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccaccctcctctctctcgactctgagcgggctggcaaggcgcatagnnnnnnn

SEQ ID NO: 174197 - DNA, 255 bp, Homo sapiens
  misc_feature: GYAE6OF02GYAO8.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgtccggcggagggaccaagctgaccgtctaggtcagcccaaggctgccccctggtcactctcgttcccgcccttcctctctctcgactctgagcgggctggcaaggcgcatgnnn

SEQ ID NO: 174198 - DNA, 273 bp, Homo sapiens
  misc_feature: GYAE6OF02FWWBX.49.65.F10.1.454.CMB.1.raw
  modified_base (253)..(273): a, c, t, g, unknown or other
  misc_feature (253)..(273): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnnnnnnnnnnnnnnnnnn

SEQ ID NO: 174199 - DNA, 703 bp, Homo sapiens
  misc_feature: GYAE6OF02IUEJ6.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtctgggggaggcgtggtccagcctgggacggtccctgagactctcctgtgagcctctggattcaccttcaagaactttggcatgcacgtgggtcccgccacggcctccgaggcgacgggggctgggaggtggggtcggctaggttatctcgagtatgagtaggaaagttaaaaagtacgttaagttacggacttaccgttaggaacggggtccctaattccgaccctattcctaccgaacgaacgaacaaacgttacccaaagtaaacctacccttgacctacttaccgtaaactaaacgtacgacctaacgtacgttaccgtaggaaccgtacccgtagggaacggaaccgtaaccgggtcgttaggtacgtttaaattaccgttggtacgggaacggggtaaagggggggtgggtttaagtttttacggacgttaacggtttccggaacccgttacgtttaccggaccgttaaccgggttacggggacccgtaacccggggg

SEQ ID NO: 174200 - DNA, 256 bp, Homo sapiens; identical to SEQ ID NO: 173592
  misc_feature: GYAE6OF02GYH16.49.65.F10.1.454.CMB.1.raw
  modified_base (253)..(256): a, c, t, g, unknown or other
  misc_feature (253)..(256): n is a, c, g, or t

SEQ ID NO: 174201 - DNA, 753 bp, Homo sapiens
  misc_feature: GYAE6OF02HCKTI.49.65.F10.1.454.CMB.1.raw
  modified_base (302)..(302): a, c, t, g, unknown or other
  misc_feature (302)..(302): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggaggcgtggtccagcctgggaggtccctgagactctcctgtgaacgcctcgtggtattccaccttcaaagtactttggctatcgctacgtgggtccnccgaggcctccgaggcgacggggtctagggaggtggggtgcgtagtttatcctacgagtatggaagtagggaaaacgttaaaagttacgttaacgttaccggacttcgttaggaacggggtccctattacccgaaccgtattaccctaccgaagtaacgtaaccgtaaaacgttacccaaaacgtaaacctaaccgttacgaacctaacttaaccgtaaacgtaaaacttcgaacctaacgtacggttacctaggaaccgtaccgtacgaacgggaaccgacgggttcgttaggttacgttaacgtttacgtacgggtacgggtaacggggtaacgggggggtaggggtttaacggtttttacgggaccggttaacggtttacccgggtaacccttaccggttaccggtaaccggttaacgggttaccgggggtaacccgtaacccggggg

SEQ ID NO: 174202 - DNA, 285 bp, Homo sapiens
  misc_feature: GYAE6OF02HWMNP.49.65.F10.1.454.CMB.1.raw
  modified_base (258)..(285): a, c, t, g, unknown or other
  misc_feature (258)..(285): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctgttcccaccctcctctctctcgactctggagcgggctggacaaggcgacatagnnnnnnnnnnnnnnnnnnnnnnnnnnnn

SEQ ID NO: 174203 - DNA, 624 bp, Homo sapiens
  misc_feature: GYAE6OF02HQJ6D.49.65.F10.1.454.CMB.1.raw
  modified_base (544)..(544): a, c, t, g, unknown or other
  misc_feature (544)..(544): n is a, c, g, or t
tcagagtcgagagacacgaccggtgctcgatttagctacgctctaaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggaggcgtggtccagcctgggaggtccctgagacctctcctgtgaacgcctcgtggattccaccttcaaagtaactttggacatgacacgtcgggtccgccagggcctccgaggccgacgggggctgggaggtggggtggcgtagttatctacgagtatgatagggtaaagtaaaacgtacttagttaccggtactccgttagaacggggcctattaccactactcctaccaagacgaactaactaccgaaagaactaccttgactaactactaactaaagtcgaccacgacgtactagaacgacgtaggacgacgacgtcgtagtagtagttacnggtggacggtaagggggtaggttagtttgacgttagtcgtaccgtacgttacgtacgtacggtcgggtaccgtaaccggg

SEQ ID NO: 174204 - DNA, 261 bp, Homo sapiens; identical to SEQ ID NO: 174168
  misc_feature: GYAE6OF02H4E8G.49.65.F10.1.454.CMB.1.raw
  modified_base (253)..(261): a, c, t, g, unknown or other
  misc_feature (253)..(261): n is a, c, g, or t

SEQ ID NO: 174205 - DNA, 583 bp, Homo sapiens
  misc_feature: GYAE6OF02GT25A.49.65.F10.1.454.CMB.1.raw
  modified_base (294)..(294): a, c, t, g, unknown or other
  misc_feature (294)..(294): n is a, c, g, or t
  modified_base (410)..(410): a, c, t, g, unknown or other
  misc_feature (410)..(410): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtcccagcctggggaggtccctgagactctcctgtgaagcctctggattcaccttcaagactttggcatgcactgggtccncaggctccgaggcacggggctgggagtgggtgcaggttatctcagatgagtggaaagtaaaagtctagttcgactcgttggaaggccgattcaccatcctcagagacaataccaanaactacttcgcagtctaacaaactacgacacagtctacgacgacctggacggacgacggcgttgtagtacttacgtgtagggacgggtaaggggggtcggggttagtttttcggacgttagttacggtacccgtacttaccggtacgtacggttacggggccgtaacccgggg

SEQ ID NO: 174206 - DNA, 261 bp, Homo sapiens
  misc_feature: GYAE6OF02F8F1S.49.65.F10.1.454.CMB.1.raw
  modified_base (253)..(261): a, c, t, g, unknown or other
  misc_feature (253)..(261): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnnnnnn

SEQ ID NO: 174207 - DNA, 258 bp, Homo sapiens
  misc_feature: GYAE6OF02HW3LK.49.65.F10.1.454.CMB.1.raw
  modified_base (250)..(250): a, c, t, g, unknown or other
  misc_feature (250)..(250): n is a, c, g, or t
  modified_base (252)..(258): a, c, t, g, unknown or other
  misc_feature (252)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccgccctcctctctctcgactctgagcggctggcaggcgcangnnnnnnn

SEQ ID NO: 174208 - DNA, 268 bp, Homo sapiens
  misc_feature: GYAE6OF02G6KYE.49.65.F10.1.454.CMB.1.raw
  modified_base (255)..(258): a, c, t, g, unknown or other
  misc_feature (255)..(258): n is a, c, g, or t
  modified_base (260)..(268): a, c, t, g, unknown or other
  misc_feature (260)..(268): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagcccaaggctgccccctggtcactctgttcccaccctcctctctcctcgactctgagcgggctggcaaggcgcatagnnnngnnnnnnnnn

SEQ ID NO: 174209 - DNA, 257 bp, Homo sapiens; identical to SEQ ID NO: 173529
  misc_feature: GYAE6OF02GEF13.49.65.F10.1.454.CMB.1.raw
  modified_base (253)..(257): a, c, t, g, unknown or other
  misc_feature (253)..(257): n is a, c, g, or t

SEQ ID NO: 174210 - DNA, 611 bp, Homo sapiens
  misc_feature: GYAE6OF02F8ZKO.49.65.F10.1.454.CMB.1.raw
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (435)..(435): a, c, t, g, unknown or other
  misc_feature (435)..(435): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
  modified_base (608)..(608): a, c, t, g, unknown or other
  misc_feature (608)..(608): n is a, c, g, or t
tcagagtcgagagacacgaccggtgctcgattttagctacgctctaagggacgtacgggccacccgtgacccatcacgcagggtcgaagccggggatgaggccgacctattacgtgtcacgttgtgggacagtagtagtgatcgactgtggtcgttcgggcgggaggggtaccaaggcgtggaccgtcctaaggtcaagcccaaggctggccccctggtcacgttcgtcggttccccacccttcctcgtaccgtcctacgtacctccgtgacggtcccgggctacgggaccaaacgggtcccgacgtaaacttacggntnacgactacagtagatcgnagacgngcgacgacgacgtactattntacgtcgtgacgactacaganancgacgacgtcgtgacgacgtagtacgacgtacgacgtacgtcgccgcnccgtacaccacgacgacgcgtacgtccgtccgtccgtcgccgtcnctacgtacgacgacnccgtacgcgacgacacgacgcgcgcgcgcgtcgtcgtcgtacgacgtactactacgtacgtacgagtacgtcgacggacggacgtacgtccgacggacgacgagtacgtacgntcg

SEQ ID NO: 174211 - DNA, 323 bp, Homo sapiens
  misc_feature: GYAE6OF02IVMDC.49.65.F10.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (273)..(274): a, c, t, g, unknown or other
  misc_feature (273)..(274): n is a, c, g, or t
  modified_base (276)..(276): a, c, t, g, unknown or other
  misc_feature (276)..(276): n is a, c, g, or t
  modified_base (283)..(323): a, c, t, g, unknown or other
  misc_feature (283)..(323): n is a, c, g, or t
tcagagtcgagagacacgaccggtgctcgattttagctacgctctaaggggacgtacgggccaccctgaccatcagcagggtcgaagccggggatgaggccgactagttactgtcaccgtgtgggacagtagtagtgactcatgtggtgttcggcggagggaccaagctgaccgtctaggtcagcccaaggctgccccctggtcactctcgttccccgccctcctctcgtactcgacctctgacgcgggctggcaaggccnaatgnatcgntnnancatacgnnnnnnnnnnnnnnnnnnnnnnnnnnnnnnnnnnnnnnnnn

SEQ ID NO: 174212 - DNA, 606 bp, Homo sapiens
  misc_feature: GYAE6OF02IAED1.49.65.F10.1.454.CMB.1.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (449)..(449): a, c, t, g, unknown or other
  misc_feature (449)..(449): n is a, c, g, or t
  modified_base (485)..(485): a, c, t, g, unknown or other
  misc_feature (485)..(485): n is a, c, g, or t
tcagagtcgagagacacgaccggtgctcgatttagctacgctctaagggggggagaggagcccagcactagaagtcggcggtgtttccattcggtgatcagcaactgaacacagaggactcaccatggagtttgggctgagctgggtttttcctcgttgcttcttttaagaggtgtccagtgtcaggtgcagctggtggagtcgtgggggaggcgtggtccagccgtgggacgtccctgagactctcctgtnagcctntggattcaccttcaagtaactttggcatgcacgtcgggtcccnccgaggcctccgagggccgacggggctgggagtcggggtgactaggttactcgtcgagactgagtaggaaagttaaaagtctagtacggactccgttaggaaggccatacacctactctcagacaactaactaccgaataacacttanactactactaacaatcacatacgtactgacgaccgngaagtacgtcggcttagtcgttagttacgtgtaggtacgggtaaggggggaggttaagttttggaacgttagtaccggaccttacgttacggtaccgtacggtacgggacccgtaaccggg

SEQ ID NO: 174213 - DNA, 851 bp, Homo sapiens
  misc_feature: GYAE6OF02HFVSH.49.65.F10.1.454.CMB.1.raw
  modified_base (315)..(315): a, c, t, g, unknown or other
  misc_feature (315)..(315): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagcctgggagtccctgagactctcctgtgaagccctcgtggtacttccgacctttcgaaagtaaccgtttggctaagttggcctacgttggggtcccnccgaagggtccctaccgaggtaccgacgggggtcttacgggaggttcggggtacgggcgtaacggtttactaccgttcgaacgtacgttgaacgtttacggggaaaagttaaaaaacgttccgttaagtttaccgggtaactttacccgtttaaggaaaccggggtcccttaatttcccgaaacccgtagtttacccgtacccgtaaggaacgtaaccgtaaacgtttaacccgaaacggtaaaccctaaccgttacgtacctaaccttaaccgttaaacgtaaacgttaccgtaaccgtaaccgtaacggtaccgtacgggtaaaccgtacccgttacgggaaccggtaacccggtaacccgggttacgttacggttacgttaacgttaccgggtacgttacggggtaacgggttaaacgggggggtaaccgggtttaaggtttttaccgggacggtttaacggttccgggttaacccgtaccggtttaacgtaacccggttaaccgggttccgggtaacccggtaaccccgggg

SEQ ID NO: 174214 - DNA, 596 bp, Homo sapiens
  misc_feature: GYAE6OF02FJKJH.49.65.F10.1.454.CMB.1.raw
  modified_base (256)..(256): a, c, t, g, unknown or other
  misc_feature (256)..(256): n is a, c, g, or t
  modified_base (427)..(427): a, c, t, g, unknown or other
  misc_feature (427)..(427): n is a, c, g, or t
  modified_base (495)..(495): a, c, t, g, unknown or other
  misc_feature (495)..(495): n is a, c, g, or t
tcagagtcgagagacacgaccggtgctcgatttagctacgctctaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggagtccctgagactctcctgtgagcctntggattcaccttcaagtaactttggctatgcacgtgggtcccgccaggcctccgaggccacggggctgggaggtgggtggctagttatctcagataggagtaggaaagttaaaaagtactaagtttccggaacttccgtaggaacgggccgtattcaccatcctacgaganactaataccaaagaacctacttgctatactacaaatcacactagtctgacgacgtggaagacgacgtntgtgtacttacgtgtcggagggtaaggggggtggttaggttttggacgttagttacggtaccctcggttacgtacgttacggtcggggtaccgtaaccggg

SEQ ID NO: 174215 - DNA, 746 bp, Homo sapiens
  misc_feature: GYAE6OF02I3G61.49.65.F10.1.454.CMB.1.raw
  modified_base (152)..(152): a, c, t, g, unknown or other
  misc_feature (152)..(152): n is a, c, g, or t
  modified_base (253)..(253): a, c, t, g, unknown or other
  misc_feature (253)..(253): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtggggagcgtggtccagccgtggagtccgtcgagactctctgtgagctctgntcacctacaagaattcgcgatgcgaacgtcggtccgccgacgctccgacggcgaccgggcggtaggacggtggggtacgcgtaacgttacgtcgtacgtaggagttagagtagggtaaaagttaaaaacgtacgttagtttaccggaccttacgttacgggaagggaccgtactaaccaccgtaactcgtacccgaacgtaacgtaaccgaacttaacccgtaagtaaacccgtaaccttacgacctaacttaaccgtaactaaaacgttacaaccgtacgtaagtaccgtacgaacgtaaaccggtacgaacgggtaaaccgaccgggacgttacgttaacgttaacgttaacgtttaggtaccgggtaacgggggtaaagggttacgggggtaggttttttaccggaacggttaacggtttacccggtaacccggttaacgttacgggtaaccggttacggttaaccgggggtcccggtaaaccccggggg

SEQ ID NO: 174216 - DNA, 269 bp, Homo sapiens
  misc_feature: GYAE6OF02GKFJW.49.65.F10.1.454.CMB.1.raw
  modified_base (247)..(247): a, c, t, g, unknown or other
  misc_feature (247)..(247): n is a, c, g, or t
  modified_base (253)..(269): a, c, t, g, unknown or other
  misc_feature (253)..(269): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggttcagcccaaggctgccccctggtcactctgtcccgcctcctctctctcgaatctgagcgggctggcaaggcncatagnnnnnnnnnnnnnnnnn

SEQ ID NO: 174217 - DNA, 620 bp, Homo sapiens
  misc_feature: GYAE6OF02G5W4W.49.65.F10.1.454.CMB.1.raw
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcggtcgttcgcgtaggctcttaagtaggtncngtntcaggtgcagctggtgagtcgtggggcgcgtcggtccagtcctgggcgtcccngacnctctccgttgacgacgtcctcgnggtacttcctaccgttacaagtaacgttttggaccagttcgcgtacgttcggcccgacgacggtcctacgcggcggacggtcgaggtcggtggngacgtagtatccganaagntagagttagaaagtaagtctagtctacgtgtaggaccggctactacactatctaccgagtaacactaactacaacgtaacgtccctagacctaactactaactaacgactacacgtcgttacgagaacgacgtacgacgacgtcggtatcgttacgtactttgacgtacgggacgggtagggtaacggtttcgttaggtctaacgttacgtaccgtgttaccgaccggttcggacccgggacgtaacccggg

SEQ ID NO: 174218 - DNA, 262 bp, Homo sapiens
  misc_feature: GYAE6OF02ISYM8.49.65.F10.1.454.CMB.1.raw
  modified_base (256)..(262): a, c, t, g, unknown or other
  misc_feature (256)..(262): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccccctggtcactctgttccccgccctcctctctctcgactctgagcgggctggcaaggcgcatagnnnnnnn

SEQ ID NO: 174219 - DNA, 266 bp, Homo sapiens
  misc_feature: GYAE6OF02FSK7R.49.65.F10.1.454.CMB.1.raw
  modified_base (258)..(266): a, c, t, g, unknown or other
  misc_feature (258)..(266): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatggtggtgttcgggcggagggaccaagctgaccgtcctaggtcagcccaaggctgcccccctggtcactctcgttccccaccctcctctcctctcgactctgagcgggctggcaaggcgcatagnnnnnnnnn

SEQ ID NO: 174220 - DNA, 299 bp, Homo sapiens
  misc_feature: GYAE6OF02H10TM.49.65.F10.1.454.CMB.1.raw
  modified_base (185)..(185): a, c, t, g, unknown or other
  misc_feature (185)..(185): n is a, c, g, or t
  modified_base (293)..(299): a, c, t, g, unknown or other
  misc_feature (293)..(299): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggngggaccaagctgaccgtcctaggtcagcccaaggctcgccccctggtcactctgttccccaccctcctctcctctcgacttctgacgcgggctggcaaggcgcatagnnnnnnn

SEQ ID NO: 174221 - DNA, 278 bp, Homo sapiens
  misc_feature: GYAE6OF02HHYFD.49.65.F10.1.454.CMB.1.raw
  modified_base (247)..(247): a, c, t, g, unknown or other
  misc_feature (247)..(247): n is a, c, g, or t
  modified_base (254)..(256): a, c, t, g, unknown or other
  misc_feature (254)..(256): n is a, c, g, or t
  modified_base (258)..(278): a, c, t, g, unknown or other
  misc_feature (258)..(278): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcnctatagnnntnnnnnnnnnnnnnnnnnnnnn

SEQ ID NO: 174222 - DNA, 290 bp, Homo sapiens
  misc_feature: GYAE6OF02HDB9V.49.65.F10.1.454.CMB.1.raw
  modified_base (288)..(290): a, c, t, g, unknown or other
  misc_feature (288)..(290): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctggtcactctcgttcccaccctcctctctctcgactctgagcgggctggcaaggcgcatagnnn

SEQ ID NO: 174223 - DNA, 294 bp, Homo sapiens
  misc_feature: GYAE6OF02GXE9V.49.65.F10.1.454.CMB.1.raw
  modified_base (248)..(248): a, c, t, g, unknown or other
  misc_feature (248)..(248): n is a, c, g, or t
  modified_base (252)..(256): a, c, t, g, unknown or other
  misc_feature (252)..(256): n is a, c, g, or t
  modified_base (258)..(259): a, c, t, g, unknown or other
  misc_feature (258)..(259): n is a, c, g, or t
  modified_base (261)..(294): a, c, t, g, unknown or other
  misc_feature (261)..(294): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcnatgnnnnncnncnnnnnnnnnnnnnnnnnnnnnnnnnnnnnnnnnn

SEQ ID NO: 174224 - DNA, 293 bp, Homo sapiens
  misc_feature: GYAE6OF02HP8NT.49.65.F10.1.454.CMB.1.raw
  modified_base (286)..(293): a, c, t, g, unknown or other
  misc_feature (286)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgacgtcctaggtcagcccaaggctgcccctggtcactctcgtcccaccctcctctctctcgactctgagcgggctggcaaggcgcatagnnnnnnnn

SEQ ID NO: 174225 - DNA, 584 bp, Homo sapiens
  misc_feature: GYAE6OF02HL4PJ.49.65.F10.1.454.CMB.1.raw
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
  modified_base (505)..(505): a, c, t, g, unknown or other
  misc_feature (505)..(505): n is a, c, g, or t
tcagagtcgagagacacgaccggtgctcgatttagctacgctctaaggggggggagaggagcccagcactagaagtcggcggtgtttccattcggtgatcagcactgaacacagaggactcaccatggagtttgggctgagcttgggttttcctgttgcttcttttaagaggtgtccagtgtcaggtgcagcgtggtggagtcgtgggggaggcgtggtccagcctggggacggtccctgacgactctcctgtgaagcctgtaggacttcaccttnaaacgtacgtttggctatgcacgtgggtccnccgacggcctccgaggccgacggggcgtggnggtgggtgctagttatcgtnagntgagtaaggaaataaaagtctagtcgacttcgtagacggcctagtcactatcacaganaactatacaagactacgtnactatactaataatcactactntacgtgaacacgtagaaggtccacggttntaggtagtaattacgnggtacggcgggtaagggggtggttagtttcggacgttagtacgtaacgttctagtaccgtacggtgggaccctaacggg

SEQ ID NO: 174226 - DNA, 673 bp, Homo sapiens
  misc_feature: GYAE6OF02IGB15.49.65.F10.1.454.CMB.1.raw
  modified_base (310)..(310): a, c, t, g, unknown or other
  misc_feature (310)..(310): n is a, c, g, or t
  modified_base (531)..(531): a, c, t, g, unknown or other
  misc_feature (531)..(531): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggttttcctcgttgcttcttttaagaggtgtccagtgtcgaggtgcagctggtggtagtcgtgggggaggcgtcggtccagccgtgggaggtccctgagactctcctgtgaacgcctcgtgacttcaccttagaaagtaactttggcatcgctacgtcgggtcccncgaggcctaccgagggcgaccggggctgggtaggtgggtagcgtagtttctcgtacagtagtaggagtaagggtaaaaagttaaaagtacttaacgttaccggtaccttaccggttagggaaacggccttaactccaacctactcctaacgagaacgaacctaaacttaccaacgtaaacctacttcgacttaataacctaaactaatcgaacctaacgtntaccgtagaccgtacgtaggacgtaccgacggtactgttacgttattcgtaggcgggtacgggtagggggtacggtttagttttggccgttaacgtaccggtacctacgttagtaccggtacgggtccggaccgtaaccggg

SEQ ID NO: 174227 - DNA, 267 bp, Homo sapiens
  misc_feature: GYAE6OF02GHGIU.49.65.F10.1.454.CMB.1.raw
  modified_base (256)..(267): a, c, t, g, unknown or other
  misc_feature (256)..(267): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcggctggacaaggcgcatagnnnnnnnnnnnn

SEQ ID NO: 174228 - DNA, 272 bp, Homo sapiens
  misc_feature: GYAE6OF02IMY8Q.49.65.F10.1.454.CMB.1.raw
  modified_base (253)..(253): a, c, t, g, unknown or other
  misc_feature (253)..(253): n is a, c, g, or t
  modified_base (261)..(272): a, c, t, g, unknown or other
  misc_feature (261)..(272): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggaggaccaaggctgaccgtcctaggtcagcccaaggctcgacccctggtcactctcgttccccacctctctcctactcgactctgacgcggtctgggcaaggtcnctatacgnnnnnnnnnnnn

SEQ ID NO: 174229 - DNA, 328 bp, Homo sapiens
  misc_feature: GYAE6OF02JV625.49.65.F10.1.454.CMB.1.raw
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (308)..(328): a, c, t, g, unknown or other
  misc_feature (308)..(328): n is a, c, g, or t
tcagagtcgagagacacgaccggtgctcgatttagctacgctctaaggcacgaccggtgctcgatttagctacgctctaggggacacggccaccctgaccatcagcgagggtcgaagccggggatgaggccgactattactgtcacgtgtgggacagtagtagtgatcatgtggtgttcggcggaggaccaagctgaccgtctaggtcagcccaaggctcgccccctggtcacgtctcgttaccccacctccgtctccgtctcgactcgtgagcggctggactaaggcacaagtgctnanctgcntannnnnnnnnnnnnnnnnnnnn

SEQ ID NO: 174230 - DNA, 628 bp, Homo sapiens
  misc_feature: GYAE6OF02JRJ11.49.65.F10.1.454.CMB.1.raw
  modified_base (351)..(351): a, c, t, g, unknown or other
  misc_feature (351)..(351): n is a, c, g, or t
  modified_base (494)..(494): a, c, t, g, unknown or other
  misc_feature (494)..(494): n is a, c, g, or t
tcagagtcgagagacacgaccggtgctcgatttagctacgctctaagggggggagaggagcccagcactagaagtcggcggtgtttccattcggtgatcagcactgaacacagaggactcacgatggagttgggctgagctgggttttcctcgttgctcttttagaggtcgtcagtgtcgaggtgctagctgggtggagtcgtgggggagtcgtggtccagccgtgggacggtccctgagctctcctgtagacgcctgtgatccacttacaagtaacttggacatcgacacgtcgggtaccgcctacgtctaccgaggcgtaccgggctgggaggtgggtgtacgagttcnctacgagacgtggaactagggaaaagttaaacgtcgtagtttaccggtacttacggtagaacggtcctacttaccgacctatcctcgaaaggactaactactacgaaatacctactgactactacaataacgcacgtaatcgntacgacgacgagtacgaccgagtacttagggtacttaacgtcgagggtccgtaaggggtaacgggttagggttacctttgggacttacgtacgacccgttaggtccaaccggtcggtaccgggacccgtaaacg

SEQ ID NO: 174231 - DNA, 337 bp, Homo sapiens
  misc_feature: GYAE6OF02IXRKE.49.65.F10.1.454.CMB.1.raw
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (312)..(337): a, c, t, g, unknown or other
  misc_feature (312)..(337): n is a, c, g, or t
tcagagtcgagagacacgaccggtgctcgatttagctacgctctaaggcacgaccggtgctcgatttagctacgctctagggacacggccaccctgaccatcagcagggtcgaagccggggatggaggccgatattactgtcacgtgtggacagtagtagtgatcatgtggtgttcggnggaggaccaagctgaccgtcctaggtcncggcccaaggtcctccgccccctcggtcactcctcgttccccaccctctcctcctactccgtactccngacgtcggcgtggacaggccganagtagnantncnannnnnnnnnnnnnnnnnnnnnnnnnn

SEQ ID NO: 174232 - DNA, 257 bp, Homo sapiens
  misc_feature: GYAE6OF02F487F.49.65.F10.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctctctctctcgactctgagcggctggcaaggcgcatagnnnnnn

SEQ ID NO: 174233 - DNA, 262 bp, Homo sapiens
  misc_feature: GYAE6OF02FS9TX.49.65.F10.1.454.CMB.1.raw
  modified_base (252)..(262): a, c, t, g, unknown or other
  misc_feature (252)..(262): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgagcgggctggcaaggcgcatagnnnnnnnnnnn

SEQ ID NO: 174234 - DNA, 260 bp, Homo sapiens
  misc_feature: GYAE6OF02GR38F.49.65.F10.1.454.CMB.1.raw
  modified_base (253)..(260): a, c, t, g, unknown or other
  misc_feature (253)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnnnnn

SEQ ID NO: 174235 - DNA, 788 bp, Homo sapiens
  misc_feature: GYAE6OF02H1WUR.49.65.F10.1.454.CMB.1.raw
  modified_base (258)..(258): a, c, t, g, unknown or other
  misc_feature (258)..(258): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctgggtggagtcgtggggggaggcgtggtccaggcccgtgggaggtccctggagctctctgtgcagcctntggacttcactttagctagtttgccagtcgggctcggggtccacgaggcctccggaaggggaacgggctgggagtcgggtctacgtaacgttagtaggtacggttagttcgggtaaccttaaccgaactattaaccgtacggacgtaacgtaccgttccgggtaagggtaaccggggtcccttacgttacccaaaccctacgttcccgtaccgaaggtaacggtaacctaaacgtttacccgaaaacgtaaaaccgtacgttacggggttacgttttccggtaacgtaaccgttaaaagtcgggtaaacgtccgtaaacgtacccgtaagggacggaaccgggtaacccgggtaaccgggaacccgtaacccggggtaccgttaaacgttaccgttaacggtaacggttacggtaaccggttaaacggttccggtcggttacggtacgttaacgggtaacttacgtttaccggtacgtaccggggtaccgggtaaccggaacggggttaaccccgtgggttaacccccgg

SEQ ID NO: 174236 - DNA, 734 bp, Homo sapiens
  misc_feature: GYAE6OF02HFBKQ.49.65.F10.1.454.CMB.1.raw
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttacttttaagaggtgtccagtgtcaggtgcagcgtgggtggagtcgtggggggaggcggtggtccagccgtgggacggtccctgacgactctcctgtagaacgcctgtggtcttacaccttnaaacgtaactttggcaatgcacgtggtccncaggcctacgacggcgacggggctggaggtcggggtgactagttactcgtcaaggtatggaagttaacgggaaaagttaaaaagttcgttaagttaccggacttccggttaggaacgggtccgtattaccaccgtacttaccgacgaaggtacgtaactaaacgttaccgaaactaacctaccgttagactaacttaccgaaactaagttacgactaacgtacgtccgtaagaaaccggtaccgtacgggaacggtaccgtaccgggctttacgggtactttaaacgttcgtacgtacggggtaacggggggtaagggggggtacgggttttagtttttacggaccggttagtttaccgggtacccttaacggttacggttaacccggttacgggttaccggggtacccggtaaaccccgggg

SEQ ID NO: 174237 - DNA, 718 bp, Homo sapiens
  misc_feature: GYAE6OF02FQKXT.49.65.F10.1.454.CMB.1.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
tcagagtcgagagacacgaccggtgctcgatttagctacgctctaagggggggagaggagcccagcactagaagtcggcggtgtttccattcggtgatcagcactgaacacagaggactcaccagtggagtttgggctgagctgggtttttcctcgttgcttcttttaagaggtgtccagtgtcgaggtgcagcgtggtggagtcgtggggggnggcgtggtccaggcccgtggggaggtccctgagactcctccgtgtgaacgcccttntggactttccacccttacaaagtaacctttggcatgcacgtgggtcccgccaggcctccgaggcgacggggctgggaggtggggtggcgtagttacgtcgtacgaagtatgaagtaaggtaaaagttaaaaacgtacttaagttacggtaccttccgttaggaacgggactacgttaccacctactacctaccgaagtaagtaacctaaacgttaccgaaacgaaacctaccgttgaccattacctaaactaaacgttgacctaactagtaccgtaggaacgtaccgtagaacggtaacgtacggtacgttgtacgttaacttacgttagggtacggtaacgggggtaaggggggtaacgggtttagttttacggtaacgttacgttaaccgggtacccttacgttaccggtaccgttaacgggtccgggggtaccgtaacccggggg

SEQ ID NO: 174238 - DNA, 715 bp, Homo sapiens
  misc_feature: GYAE6OF02FUQ1G.49.65.F10.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggagtccctgagacctctcctgtgaagccctctggattccaccttcaaagtaactttggcaatgctacgtggggtccnccgaggctccgaggccgacggggctgggagtggggtggctagttnctcagatgagtaggaaagtaaaagtctaagtcggacttccgtaggaacgggcctaagttcaccctatacctaccgaagacgaactaaacgttaccaaacgtaacctaacccgttgacctaacgttacctaaactaaacgtccgtacctaaccgtaacggttacctaaggtaccgtaaccgttagggaacggaacgtaccggtcgttacgttacgttaacgtttaccgtagggtagggtaaccggggtaaggggggggttaacgggttttagtttttcggggaaccgttaagggtttacccgggtaacccgttaaccggtttaggtaacccggtttaccggttaccggggggacccttaaacccggggg

SEQ ID NO: 174239 - DNA, 267 bp, Homo sapiens
  misc_feature: GYAE6OF02JA87Y.49.65.F10.1.454.CMB.1.raw
  modified_base (254)..(267): a, c, t, g, unknown or other
  misc_feature (254)..(267): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctcctctcgactctgagcgggctggcaaggcgcatagnnnnnnnnnnnnnn

SEQ ID NO: 174240 - DNA, 932 bp, Homo sapiens
  misc_feature: GYAE6OF02JR9OW.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggacggcggttggtcccaggcccgtggggacggttccccgtaggagtaccgttccgttccctggttagaaccggtcccgttacgttggtacctttacccaccgtttaccgaaagttaaaccgtttcggactacgttcgccgtacgttcgggttcccgacgtacgggcctaccggaacgggtccggaccggggtacgttacggggtacgggtcggggttcgggtaccgttaaggttttaacgtccggttaaccgaagggtacctagggtaaacggtagggtaaaaacgttaaaaacgttccgtaagtttacccgggaacctttaccgggttaagggaaaccgggtcccggttaacctttaccaacccgttacgttccgtaaccggtaacgtaacgtaaccgttaaaccgttaccgaaacgtaaaccctaccgttacgacctaagttacctaaacgttaaacgcgtaacctaagttacgtaacgtagtaacccgaaccgttccgggaagggtacccgtaaccgggttacgtttacgggttaacgtttaaacggtttacgttacggggttaggtaaaaccgggggttaacgggggggtttaccggttttaagggttttttaccggaaaccggtttaaccgggtttaaccggtaacccccggtttaaacgttaccggttaacccgggtttaaccggggtacccgggggttaacccggtaaacccccgggggg

SEQ ID NO: 174241 - DNA, 274 bp, Homo sapiens
  misc_feature: GYAE6OF02INSCE.49.65.F10.1.454.CMB.1.raw
  modified_base (258)..(274): a, c, t, g, unknown or other
  misc_feature (258)..(274): n is a, c, g, or t
tcagagtcgagagacacgaccggtgctcgatttagctacgctctaagggacacgggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcgggctggctaaggcgacatagnnnnnnnnnnnnnnnnn

SEQ ID NO: 174242 - DNA, 528 bp, Homo sapiens
  misc_feature: GYAE6OF02JJZHC.49.65.F10.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
tcagagtcgagagacacgaccggtgctcgattttagctacgctctaagggacgacggccacccgtgaaccatcgagcaggtcgaaagccgggatgagccgactattactgtcacgtgtggacacgtagtagtgagtcatgtggtcgttcggcgaggaccaagcgtgaccgtcgtagtcagcccgaagctcgccccgtcgtcacgtcgtgttcccacctctcgtctcgtcgactctcgngcggctggacagcgacatacgncgngtcgangtcagctgtgngcgngtgngcgngngngngngngngngcgcgcgngtcgcgcgcgcgtacgcgcgcncgtcgcgcgcgcgcgcgacgcgtcgcgacgcgcgcgcgcgcgacgcgtcgacgacgacgacgtacgtcgacgtacgcgcgcgtcgtcgtcgtcgtacgcgtcgtacgtacgtacgtacgtacgtacgtcgtacgtacgtcggtcgtacgtacgcgtacgtacgtcgtacgtcgtcgtccgtccgtacgtacg

SEQ ID NO: 174243 - DNA, 270 bp, Homo sapiens
  misc_feature: GYAE6OF02FO1E7.49.65.F10.1.454.CMB.1.raw
  modified_base (248)..(248): a, c, t, g, unknown or other
  misc_feature (248)..(248): n is a, c, g, or t
  modified_base (254)..(270): a, c, t, g, unknown or other
  misc_feature (254)..(270): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctgttcccacctcctctctctcgactctgacgcggctggcaaggcncatagnnnnnnnnnnnnnnnnn

SEQ ID NO: 174244 - DNA, 831 bp, Homo sapiens
  misc_feature: GYAE6OF02HHWLZ.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggtttttcctcgttgcttcttttaaagaggtgtccagtgtcgaggtgcagcgtggtggagtcgtgggggagtcgtggtccagtccgtgggacgtcctgagactctccgtgtgaagcctcgttaggacttcctaaccttacgtaaacgtaaacttttggactaagtacgtacaccgtcggggtccccgccgaacggcctacccgaggccgaacgggggttcctaggggtacggtgggggtacggtcgtaaacggttttacgtaccgtacgtaaggtaacgtaggtaagttaaagggggtaaaaagtttaaaaaaaggttaccgttaaaggttttacccggaaccgtttacccgttaggggaaacggggtacccgtaactttaaccgaacccgtaacttaccgtaacccgtaaggaacgtaaacgttaaaccgtttaaccgaaaaccggtaaactaaccggttacgacctaacgttaccgttaaactaaacgtcgtaaccacgtaacgtaccgtacgaacgtacccgtaggaaccgaccgaacggtcgttaggttacgttaacgttacgtaggtacggtaacggggaaggggggttaacgggttacttttacggaacgttacgttaaccggtaccctttaacgttacggtaaccggtaaccggttaccggggtaacccgtaaaccgggg

SEQ ID NO: 174245 - DNA, 326 bp, Homo sapiens
  misc_feature: GYAE6OF02GHW5L.49.65.F10.1.454.CMB.1.raw
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (261)..(326): a, c, t, g, unknown or other
  misc_feature (261)..(326): n is a, c, g, or t
tcagagtcgagagacacgaccggtgctcgatttagctacgctctaagggacgacggccaccctgaccatcagcagggtcgaagccggggatgagccgactattactgtcacgtgtgggacagtagtagtgatcatgtggtgttcggcggagggaccaagctgaccgtcctaggtcagcccaaggctgcccccctggtcactctgttcccaccctcctctctctcgactctgagcggctggcaaggcgcaatagntntacannnnnnnnnnnnnnnnnnnnnnnnnnnnnnnnnnnnnnnnnnnnnnnnnnnnnnnnnnnnnnnnnn

SEQ ID NO: 174246 - DNA, 866 bp, Homo sapiens
  misc_feature: GYAE6OF02GN8EV.49.65.F10.1.454.CMB.1.raw
  modified_base (153)..(153): a, c, t, g, unknown or other
  misc_feature (153)..(153): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggttttccncgttgcttacttttaaggaggtgtaccagtgtacgaggtgcagtcgtggtggagtcggtgggggagcgtggccagtccgtggggacggtccctaggacgtaccttccgtccgtaggtacgaacgtcccttgtaggtacttccaaccgttacgaaacgttacgtttggactagtcgacgtacgtcggggtacccaccggaacggtcctaccggacgggaccggtaccgggggtcgtacggggtacgggttcgggtcggacgttaaggtttactcgtaacgaaggtgtaacggtaaggtaaacgggtaaaaagtttaaaacggtcttaacggttacggtaaccttacgggtaaggtaacggggtaccctacttaaccgaacccgtagtacccgtaacgaacgtaacgtaaacctaacgttaaccgtaaaccgtaacccgtaaccgttacgtaccgtaacttaacctaaaccgtaaacgtccgtaaccgtaacgtaaccggtacgtaaccgggtaaccgttaacccggacgggtaaacccgacggttaccggtaacgttacggttaccgtttaacgttaccggttagggtacggggtaacggggtaaggggggttaacggttacggtttttacggaaccgttacggttaacccggttaaccgttaacggttaccggtaaccgggtaacgggttaccgggtaacccggtaacccggg

SEQ ID NO: 174247 - DNA, 288 bp, Homo sapiens
  misc_feature: GYAE6OF02GACMI.49.65.F10.1.454.CMB.1.raw
  modified_base (254)..(288): a, c, t, g, unknown or other
  misc_feature (254)..(288): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcaatagnnnnnnnnnnnnnnnnnnnnnnnnnnnnnnnnnnn

SEQ ID NO: 174248 - DNA, 277 bp, Homo sapiens
  misc_feature: GYAE6OF02JTSRW.49.65.F10.1.454.CMB.1.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (259)..(261): a, c, t, g, unknown or other
  misc_feature (259)..(261): n is a, c, g, or t
  modified_base (263)..(277): a, c, t, g, unknown or other
  misc_feature (263)..(277): n is a, c, g, or t
tcagagtcgagagacacgaccggtgctcgatttagctacgctctaagggacacggccaccctgaccatccagcaggtcgaagccggggatgaggccgacgtattactgtcacgtgtgggacagtagtagtgatcatgtggtgttcggcggagggaccaaggctgaccgtccgtaggtcagcccaaggtctgccccctggtcactctattcccaccctctctctcncgactctgacgccggctggcaaggcncatagncnnnannnnnnnnnnnnnnn

SEQ ID NO: 174249 - DNA, 271 bp, Homo sapiens
  misc_feature: GYAE6OF02IKCLY.49.65.F10.1.454.CMB.1.raw
  modified_base (228)..(228): a, c, t, g, unknown or other
  misc_feature (228)..(228): n is a, c, g, or t
  modified_base (252)..(255): a, c, t, g, unknown or other
  misc_feature (252)..(255): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (263)..(271): a, c, t, g, unknown or other
  misc_feature (263)..(271): n is a, c, g, or t
tcagagtcgagagacacgaccggtgctcgatttagctacgctctaaggggacacggccaccctgaccatcagcagggtcgaagccgggatgaggccgactattactgtcacgtgtgggacagtagtagtgatcatgtggtgttcggcggaggaccaagctgaccgtctaggtcagcccaaggctcgccccctggtcactctcgttcccacctctctctactcgactcngacgcggctggccaggcgcatcgnnnnatngnagnnnnnnnnn

SEQ ID NO: 174250 - DNA, 318 bp, Homo sapiens
  misc_feature: GYAE6OF02H4MOE.49.65.F10.1.454.CMB.1.raw
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (291)..(292): a, c, t, g, unknown or other
  misc_feature (291)..(292): n is a, c, g, or t
  modified_base (294)..(296): a, c, t, g, unknown or other
  misc_feature (294)..(296): n is a, c, g, or t
  modified_base (298)..(298): a, c, t, g, unknown or other
  misc_feature (298)..(298): n is a, c, g, or t
  modified_base (301)..(318): a, c, t, g, unknown or other
  misc_feature (301)..(318): n is a, c, g, or t
tcagagtcgagagacacgaccggtgctcgatttagctacgctctaagggcacgaccgtagctcgatttagctacgctctaggggacacggccaccctgaccatcagcagggtcgaagccggggatgaggccgactattactgtcacgtgtgggacagtagtatgatcatgtggtgttcggacggaggaccagctgaccgtcctaggtcagcccgaggtctcgcccctggtcactcncgttacccaccctcctntcctactcgacttntgagcggctgcgaaggcncatgcnncnnngnacnnnnnnnnnnnnnnnnnn

SEQ ID NO: 174251 - DNA, 313 bp, Homo sapiens
  misc_feature: GYAE6OF02IBWUX.49.65.F10.1.454.CMB.1.raw
  modified_base (235)..(235): a, c, t, g, unknown or other
  misc_feature (235)..(235): n is a, c, g, or t
  modified_base (297)..(313): a, c, t, g, unknown or other
  misc_feature (297)..(313): n is a, c, g, or t
tcagagtcgagagacacgaccggtgctcgatttagctacgctctaagggcacgaccggtgctcgatttagctacgctctagggacacggccaccctgaccatcagcagggtcaagccggggatgaggccgactattactgtcacgtgtgggacagtagtagtgatcatgtggtgttacggcggagggaccaagctgacgtcctaggcaggcccaaggctgccccctggtcacgtntcggttcccacctcctctctcgtcgactcctagagcgggctaggccaaggcgcagtaacgtnnnnnnnnnnnnnnnnn

SEQ ID NO: 174252 - DNA, 720 bp, Homo sapiens
  misc_feature: GYAE6OF02I5HAO.49.65.F10.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagagtcgagagacacgaccggtgctcgatttagctacgctctaagggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggaggcgtggtccagcctggggngtcccngagactcctcctgtgaacgcctctggacttcaccttcaagtaactttggacatcgcacgtgggtcccgccaggccgtccgaggccgaccgggggcgtgggaggtggggtagggcgtaagtttacgtctacagatgaagtagggaaaagttaaaaacgtacttaagttacggtacgttccttagggaacgggtcccgtaattaccaacctactcctaccgagacgaactaacttacccgaaagtaaaccctaccgttcgacccgtaactaccgttaaacaaagttacgacctaactacggttaccgtacggtacggaacccttgggaacggtaaccgaccggtagttggttacgtttaacttacgttaggtcgaacggggggtaacgggggggtacgggtttaaggttttacggtacggttaggtttacccggtaaccgttcgtttacggtaccgttacggttacgggggaccccgttaaccgggg

SEQ ID NO: 174253 - DNA, 289 bp, Homo sapiens
  misc_feature: GYAE6OF02JX543.49.65.F10.1.454.CMB.1.raw
  modified_base (265)..(271): a, c, t, g, unknown or other
  misc_feature (265)..(271): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(289): a, c, t, g, unknown or other
  misc_feature (277)..(289): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggaggaccaagctgaccgtctaggtcagccaaggctcgcccctggtcactctcgttcccaccctccgtctcctctccgactcgtgacggcggtctcgggacaacggtccgctatagcnnnnnnngnantnnnnnnnnnnnnn

SEQ ID NO: 174254 - DNA, 269 bp, Homo sapiens
  misc_feature: GYAE6OF02H4BDX.49.65.F10.1.454.CMB.1.raw
  modified_base (256)..(269): a, c, t, g, unknown or other
  misc_feature (256)..(269): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctctctctctcgactctgacgcgggctggcaaggcgacatagnnnnnnnnnnnnnn

SEQ ID NO: 174255 - DNA, 269 bp, Homo sapiens
  misc_feature: GYAE6OF02F9Q9V.49.65.F10.1.454.CMB.1.raw
  modified_base (250)..(269): a, c, t, g, unknown or other
  misc_feature (250)..(269): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcgaggaccaagctgaccgtcctaggtcagcccaaggctgccccctggtcactctgttccccacctctctctctcgactctgagcggactggacaaggcgcatgnnnnnnnnnnnnnnnnnnnn

SEQ ID NO: 174256 - DNA, 266 bp, Homo sapiens
  misc_feature: GYAE6OF02IQWSJ.49.65.F10.1.454.CMB.1.raw
  modified_base (254)..(266): a, c, t, g, unknown or other
  misc_feature (254)..(266): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgagcggctcggcaggcgcatagnnnnnnnnnnnnn

SEQ ID NO: 174257 - DNA, 304 bp, Homo sapiens
  misc_feature: GYAE6OF02GG5H5.49.65.F10.1.454.CMB.1.raw
  modified_base (287)..(304): a, c, t, g, unknown or other
  misc_feature (287)..(304): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgaggcggctggcaaggcgcatagnnnnnnnnnnnnnnnnnn

SEQ ID NO: 174258 - DNA, 265 bp, Homo sapiens
  misc_feature: GYAE6OF02GJGFD.49.65.F10.1.454.CMB.1.raw
  modified_base (255)..(257): a, c, t, g, unknown or other
  misc_feature (255)..(257): n is a, c, g, or t
  modified_base (259)..(265): a, c, t, g, unknown or other
  misc_feature (259)..(265): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccgccctcctctctctcgactctgagtcgggctggcaaggcgcatagnnngnnnnnnn

SEQ ID NO: 174259 - DNA, 854 bp, Homo sapiens
  misc_feature: GYAE6OF02GYME5.49.65.F10.1.454.CMB.1.raw
tcagagtcgagagacacgaccggtgctcgatttagctacgctctaaggggggagaggagcccagcactagaagtcggcggtgttccattcggtgatcagcactgaacacagagactcaccatggagtttgggctgagctggttttcctcgttgctctttaagaggtgtcctagtgtcaggtgcagctggtggagtcgtgggggacgcggtcgtccgagtccgttgggacgtcccgtgacgtacctcgtccgtagtcgaacgccctgtacggtacttcccgaacctttacaaagttaacgttttcgggacctaagttcgacgtacgttcgggtcccgccgaacgggtccctcccggaacggccggtaccggggtcgtacgggtagggtgggtacggacgtacggtttagtccgtacggaggtaacgtggtaagtaacgggtaaaaagtttaaaaaggtcctttaacggttaccggtaccgtttaccggttaacgggtaaacgggtaacccgtacgtttacccaaccttaacgttacctccgaaacggtagtaaaacccgtaaacgtttaacccaaacgtaaacccttaccgttacgaccttaacgttaaaccttaaacgtaacgtccgtaaccgtaacgtacggttaccgtacgtaaacggtacccgttacgggaaccggtaaccgaacgggttcccgttaagggttactttaaacggttacggttacggtacggggtaacggggtaacggggggtttcggttttaacgtttttacggaaccggtttaaccgttacgggttaacccgttacgttacggttaaccttaccgggttacgggtaccccggtaaccggg

SEQ ID NO: 174260 - DNA, 751 bp, Homo sapiens
  misc_feature: GYAE6OF02H90ZK.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggacgtccctgagactctcctgtgaacgcctcgtggacttccaccttcaagtaacgtttggactatgctacgtcgggtcccgccgaggccctccgtaggccggacggggtcgtggggaggtggggtacggtcgtaacggttattccgacgaagtagttgaagttaacgggtaaagttaaaaaacgttcttaacgtttacggtaaccttaccggttacgggaacgggtacccgtacgttaccaaccgttacgttccgtacctaggtaacgaaaccgttaaacttaacccgaaagttaaaccgtaccgttacggacctaacgttaaccaaactaaacgtcgaactaacgtacgtctacggacgtaccgtagaaccgggtacacggtacgttacgtacggttaattccgtggttaccggagggggttaacgggggtagggtttaagtttcggaacggttacggttccggtaacccgttacggttacgggtaacccgtttacgggtaccgggggtacccctaaaccggggg

SEQ ID NO: 174261 - DNA, 300 bp, Homo sapiens
  misc_feature: GYAE6OF02HI1NT.49.65.F10.1.454.CMB.1.raw
  modified_base (261)..(300): a, c, t, g, unknown or other
  misc_feature (261)..(300): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttcccgccctctctctctcgactctgacggcggctcggacaacgggcacatagcnnnnnnnnnnnnnnnnnnnnnnnnnnnnnnnnnnnnnnnn

SEQ ID NO: 174262 - DNA, 768 bp, Homo sapiens
  misc_feature: GYAE6OF02FTPM0.49.65.F10.1.454.CMB.1.raw
  modified_base (304)..(304): a, c, t, g, unknown or other
  misc_feature (304)..(304): n is a, c, g, or t
tcagagtcgagagacacgaccggtgctcgatttagctacgctctaagggggggagaggagcccagcactagaagtcggcggtgtttccattccggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtcccgtgagacctctcctgtagagccctcgtggattccaccttcaagtaactttggactatgcacgtgggtccnccgaggcctccgaggccgacgggggctagggaggtggggtggctaagttatcctcgagatcggaatagggtaaagtaaaacgtactaagttccggaacttcgttaaggaagggcctattaccacctatcctccaagacgaacctaacttaccgaaagtaacctaccttacgactaacttaccgtaaactaaacgttacgtaccaaccgttaacgtaccgtaacggtaaccgtaacccggtagggtaaaccgggtaccgtaacccggggtttatacgggttttaacggttaagttttaaccgttacgggttacgggaccgggggttaaagggggggggtaaccgggttttaagggtttttacggaaccggtttaaggtttacccgggtaaccccggtttaacggttttacccgggttacccggtttaacccggggtaccggggggtaacccctaaacccgggggg

SEQ ID NO: 174263 - DNA, 274 bp, Homo sapiens
  misc_feature: GYAE6OF02H7XY2.49.65.F10.1.454.CMB.1.raw
  modified_base (254)..(274): a, c, t, g, unknown or other
  misc_feature (254)..(274): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagccaaggctgccccctggtcactctgttcccgccctctctctctcgactctgagcggctcggcaacggcgcagtagnnnnnnnnnnnnnnnnnnnnn

SEQ ID NO: 174264 - DNA, 640 bp, Homo sapiens
  misc_feature: GYAE6OF02FVYJ4.49.65.F10.1.454.CMB.1.raw
  modified_base (154)..(154): a, c, t, g, unknown or other
  misc_feature (154)..(154): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (481)..(481): a, c, t, g, unknown or other
  misc_feature (481)..(481): n is a, c, g, or t
  modified_base (544)..(544): a, c, t, g, unknown or other
  misc_feature (544)..(544): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggcctggagctgggttttccncggttgctcttttaagaggtgtccaggtgtcaggtgnacgntggtgagtcgtgggggagcgtggtccagccgtgggacgtccctgacgactctctgtagactcctntggtattccaccttcaagtaccttggactagtgccagtcgggaccacgaggtccnccgaggccggacgggngtagggaggtcgggtagactacgttactcgacgtacgtagtgaggtaacgtaaagttaaacgtcgtacttcggacttccgtaagggacggtacctacttacgcctaagtcctacgaagtcgaaacgtactacgaaacgacctacgttacncgtaactcaaactacgttcgaactacgtacgtccgtacgacgtaccggtgacgtaccgacgtntacggtactaagttccaggtacgacgggtaggggtaggttactttacgggactacggtacgaccttagttacgacgtcggtaccggagtaaccggg

SEQ ID NO: 174265 - DNA, 317 bp, Homo sapiens
  misc_feature: GYAE6OF02JDVYE.49.65.F10.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (260)..(263): a, c, t, g, unknown or other
  misc_feature (260)..(263): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (277)..(279): a, c, t, g, unknown or other
  misc_feature (277)..(279): n is a, c, g, or t
  modified_base (281)..(281): a, c, t, g, unknown or other
  misc_feature (281)..(281): n is a, c, g, or t
  modified_base (283)..(317): a, c, t, g, unknown or other
  misc_feature (283)..(317): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtacgtgatcatgtggtattcggcggagggaccaagctgaccgtcctaggtcagcccaaggctgcccccctggtcactctgttaccccnccttctcctctctcgactctgagccgggactgggcaaggcncatagnnnnctcntnagctnagnnngntnnnnnnnnnnnnnnnnnnnnnnnnnnnnnnnnnnn

SEQ ID NO: 174266 - DNA, 847 bp, Homo sapiens
  misc_feature: GYAE6OF02GSMBN.49.65.F10.1.454.CMB.1.raw
  modified_base (239)..(239): a, c, t, g, unknown or other
  misc_feature (239)..(239): n is a, c, g, or t
  modified_base (334)..(334): a, c, t, g, unknown or other
  misc_feature (334)..(334): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcggtggtccagccgtggggacggtcccgnggacgacctccttccgtgtacgaacgcccttcgtggacttacctaccctttacgaaagtaaccttttggacctatcgacctaccgtgggtccccnccgacggcctcccgaggccggaaccggggtcgtagggagggtggggtcggacgttacggttactccgtacgaagtagtagacggttaagggtaaaaagttaaaacgttacttaacggttaccggtacgttacggttaacggtaacgggaccgtactaccgtaacctacgttacctaccgaaaggtaaccaacgttaacgttaacccgaaacgtaaaccctacgttacgaaccgttacttaaccgtaaactaaagtcccgaacaacccgttacgttacggtaacgtaaccggtaacccgtagggaaaccggtaccgtaacggtaccgttagtttaacggtttaacgttaccggttgggtaccggggtaacggggggttaaaacggggggggttagttttaccgggttttcggtaaccgggtttacggtttaaccccgggtaacccgttaacggtttaaccggggttacccgtttacgggggtaaccccggggaacccgggttaaaccccggggg

SEQ ID NO: 174267 - DNA, 678 bp, Homo sapiens
  misc_feature: GYAE6OF02I8JH0.49.65.F10.1.454.CMB.1.raw
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (530)..(530): a, c, t, g, unknown or other
  misc_feature (530)..(530): n is a, c, g, or t
tcagagtcgagagacacgaccggtgctcgatttagctacgctctaagggggggagaggagcccagcactagaagtcggcggtgtttccattcggtgatcagcactgaacacagaggactcacatggagtttgggctgagcttgggttttcctcgttgcttacttttaaggaggttgtccagtgttcaggtgcagctggtggagtcgtgggggacgcgtggtccagccgtggggacgtccctgacgacctctccgtgngaacgcctgtcgtattccaccttacaagtaactttggacatcgctacgtgggtcccncacgggcctcgacggtcggacggggtctagggnggtgggcgggtctaggttacncgtanagtagagtagtaaaggaaagtaaaagttacgttagtacggacttccggtaggaacggtctaacttcgacctaactcgtaccgagtaacgtaactaacgtaccaaacgtacctaacgtcactactactaaacaagtcgactacgtacgtcgacgtaanacccgttaggaccgtaacgtaccggttctaggttacttaacgttacgtaggtacggacgggtaacgggggttagggttacgtttaggcgttacgttacggtaccgttaggttaccctacggttaccgggtaccggtccggtaaccggg

SEQ ID NO: 174268 - DNA, 255 bp, Homo sapiens
  misc_feature: GYAE6OF02IUGR8.49.65.F10.1.454.CMB.1.raw
  modified_base (248)..(248): a, c, t, g, unknown or other
  misc_feature (248)..(248): n is a, c, g, or t
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccaccctcctctctctcgactctgagcggctggcaaggcncatgnnn

SEQ ID NO: 174269 - DNA, 320 bp, Homo sapiens
  misc_feature: GYAE6OF02F3FQ2.49.65.F10.1.454.CMB.1.raw
  modified_base (138)..(138): a, c, t, g, unknown or other
  misc_feature (138)..(138): n is a, c, g, or t
  modified_base (184)..(184): a, c, t, g, unknown or other
  misc_feature (184)..(184): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (247)..(320): a, c, t, g, unknown or other
  misc_feature (247)..(320): n is a, c, g, or t
tcagagtcgagagacacgaccggtgctcgatttagctacgctctaagggcacgaccggtgctcgatttagctacgctctaaagggcacgaccggtgctcgatttagctacgctctaaagggcacgtaccggtgctcgntttagtcaccgcgagaaagggaaggggctggccctgacgtgtttcncggttcccatctcctctacgtctacgactctagacgtgggcctggacaaggcgacaanagntnnnnnnnnnnnnnnnnnnnnnnnnnnnnnnnnnnnnnnnnnnnnnnnnnnnnnnnnnnnnnnnnnnnnnnnnnn

SEQ ID NO: 174270 - DNA, 703 bp, Homo sapiens
  misc_feature: GYAE6OF02I43EH.49.65.F10.1.454.CMB.1.raw
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
  modified_base (562)..(562): a, c, t, g, unknown or other
  misc_feature (562)..(562): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttctttaagaggtgtccagtgtcgaggtgcagcgtggtggagtcggtgggggaggcggtggtccagccgtgggacggtccctggacgtacctctcctgtgagcctcgtggnttcacctataagtacttgctatgcacgtcgggtccnccgacggcctccggacggccggacggggtcgtgggaggtcggggtggacgtagttactcgtacagtagtagtaagtaagggtaaaagttaaaacgtacgttacgttaccggtacctttaccggttacggaacgggtcccggtacttacccaaccgtactccgtaccgaacggtaaccgtaactaacctaaccgaaataacccgtaacttacggaacctaacttacctaaactaaagtccgtaactaactcggttacngggtaaactaccgtagggaaccgtacggtacggtcttggttacgttaacgttacgtgggtacggacggggttagggtaagggttctttgggacttggtaccgtacgtcgttaacgtcgtacgggtcggtaccgtaccgggg

SEQ ID NO: 174271 - DNA, 278 bp, Homo sapiens
  misc_feature: GYAE6OF02JASSR.49.65.F10.1.454.CMB.1.raw
  modified_base (256)..(278): a, c, t, g, unknown or other
  misc_feature (256)..(278): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgacggcggctggcaaggcgcatagnnnnnnnnnnnnnnnnnnnnnnn

SEQ ID NO: 174272 - DNA, 271 bp, Homo sapiens
  misc_feature: GYAE6OF02HUDTK.49.65.F10.1.454.CMB.1.raw
  modified_base (252)..(252): a, c, t, g, unknown or other
  misc_feature (252)..(252): n is a, c, g, or t
  modified_base (257)..(271): a, c, t, g, unknown or other
  misc_feature (257)..(271): n is a, c, g, or t
tcagagtcgagagacacgaccggtgctcgatttagctacgctctaagggacacggccaccctgaccatcagcagggtcgaagccggggatgagccgactattactgtcacgtgtggacagtagtagtgatcatgtggtgttcggcggaggaccaagctgaccgtcctaggtcagcccaaggctcgcccccctggtcacctctcgttccccacccctctctcctctcactctggcgccggctggaccaaggcncatgnnnnnnnnnnnnnnn

SEQ ID NO: 174273 - DNA, 271 bp, Homo sapiens
  misc_feature: GYAE6OF02IKHFI.49.65.F10.1.454.CMB.1.raw
  modified_base (258)..(271): a, c, t, g, unknown or other
  misc_feature (258)..(271): n is a, c, g, or t
tcagagtcgagagacacgaccggtgctcgatttagctacgctctaaggggacacggccaccctgaccatcagcagggtcgaagccgggggatgaggccgactattactgtcacgtgtgggacagtagtagtgatcatgtggtgttcggcggagggaccaagctgaccgtctaggtcagcccaaggctcgccccctcggtcactctgttccccaccctcctctctctcactcgtgacgcggctggacgaggcgcatagnnnnnnnnnnnnnn

SEQ ID NO: 174274 - DNA, 353 bp, Homo sapiens
  misc_feature: GYAE6OF02JCGS2.49.65.F10.1.454.CMB.1.raw
  modified_base (142)..(142): a, c, t, g, unknown or other
  misc_feature (142)..(142): n is a, c, g, or t
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (326)..(353): a, c, t, g, unknown or other
  misc_feature (326)..(353): n is a, c, g, or t
tcagagtcgagagacacgaccggtgctcgatttagctacgctctaagggcacgacccggtgctcgatttagctacgctctaggggacacggccacctgaccagtcagcagggtcgaagccggggatgaggccgactattacngtcacgtgtgggacagtagtagtgactcatggtggtcgttcggcggagggaccaaggctgaccgtcctaggtcagcccctaagggcctcgccccctggtacncttcgtcgttaccccgccctcctcgtactctacgtctcttaggngtcgggctaggccaagggtcacntagnatcantgctcnnnnnnnnnnnnnnnnnnnnnnnnnnnn

SEQ ID NO: 174275 - DNA, 272 bp, Homo sapiens
  misc_feature: GYAE6OF02F9F6J.49.65.F10.1.454.CMB.1.raw
  modified_base (256)..(272): a, c, t, g, unknown or other
  misc_feature (256)..(272): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaaagctgaccgtcctaggtcagcccaaggctgcccccctggtcactctgttccccgcctcctctctctcgactctgagcgggctggcaaggcgcatagnnnnnnnnnnnnnnnnn

SEQ ID NO: 174276 - DNA, 287 bp, Homo sapiens
  misc_feature: GYAE6OF02JFQBN.49.65.F10.1.454.CMB.1.raw
  modified_base (255)..(255): a, c, t, g, unknown or other
  misc_feature (255)..(255): n is a, c, g, or t
  modified_base (257)..(287): a, c, t, g, unknown or other
  misc_feature (257)..(287): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaaagctgaccgtcctaggtcagcccaaggctgccccctggtcactctgttccccacctcctctctctcgactctgagcgggctggcaaggcgcatagnannnnnnnnnnnnnnnnnnnnnnnnnnnnnnn

SEQ ID NO: 174277 - DNA, 275 bp, Homo sapiens
  misc_feature: GYAE6OF02HB2IU.49.65.F10.1.454.CMB.1.raw
  modified_base (255)..(275): a, c, t, g, unknown or other
  misc_feature (255)..(275): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttcccaccctcctctctcctcgactctgagcggctggcaaggcgcatagnnnnnnnnnnnnnnnnnnnnn

SEQ ID NO: 174278 - DNA, 806 bp, Homo sapiens
  misc_feature: GYAE6OF02F57ZI.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagaggactcaccatggtacgttgggctgagtcgtggttttcctcgttgcttcgttttaagaggtgtcctagtgtcaggtgcagcgtggtgagtcggtggggaggtcggtggtccgagtccgttggggacgtcccgtggacgtacctcgtccgtagtagaccgtccttcgtagtacttccacctactaagttacgtttgacctatcgacgtacgtcgggccgccgacgtccgtaccggcgggcggaacggggtccgtaggggtacgggtcgggtacggtgttaacggtttctaccgtacgtaaggtaacgtttaagggtaaagttaaaggggtaaaacgttttaaaaacggttaacgttaacgggtttaaacccggtacgtttaaccgggtttacgggaaaccgggtacccgtaaccgtttaacgaaccccgtaagtttccctaaccgtaacgtaaagtaaccctaaaacgttaacccgtaaaacgaacccgttaacccttaaggaccctaaacttaccgttaaactacttacgactaaccggtactacgttaacgaccgtaacgttacgaacggtacgtacggtactaacgtggttactacggtagtacgggaagggttacgggtcgggtactttaggacggtacgttcggaaccgtttacacgggttaccgtacgggttaccgccggtaaccggg

SEQ ID NO: 174279 - DNA, 286 bp, Homo sapiens
  misc_feature: GYAE6OF02GWLZB.49.65.F10.1.454.CMB.1.raw
  modified_base (227)..(227): a, c, t, g, unknown or other
  misc_feature (227)..(227): n is a, c, g, or t
  modified_base (264)..(286): a, c, t, g, unknown or other
  misc_feature (264)..(286): n is a, c, g, or t
tcagagtcgagagacacgaccggtgctcgatttagctacgctctaagggggacacggccaccctgaccatcagcagggtcgaagccgggggatgaggccgactattactgtcacgtgtgggacaggtagtgtgatcatgtggtgttcgggcggagggaccaagctgaccgtctaggtcagcccaggctcgccccctggtcactctcgttccccaccctcctctcctntccgactctggagccgggctggcaaggcgactagtgnnnnnnnnnnnnnnnnnnnnnnn

SEQ ID NO: 174280 - DNA, 278 bp, Homo sapiens
  misc_feature: GYAE6OF02IDUEC.49.65.F10.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (255)..(278): a, c, t, g, unknown or other
  misc_feature (255)..(278): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcgtagcagcccaggctcgccccctggtcactctcgttccccaccctcctcnctcgtcactcgtncggcggntgggacacggcncatgnnnnnnnnnnnnnnnnnnnnnnnn

SEQ ID NO: 174281 - DNA, 883 bp, Homo sapiens
  misc_feature: GYAE6OF02I32DE.49.65.F10.1.454.CMB.1.raw
tcagagtcgagagacacgaccggtgctcgatttagctacgctctaagggggggagaggagcccagcactagaagtcggcggtgtttccattcggtgatcagcactgaaacacagaggactcaccatggagtttgggctgagctgggttttcctgttgcttcttttaagaggttgtccagtgtcaggtgcagtcgtgggtggagtcgtgggggaggcggtggtccaggccgtggggacggtcccgtggacgactctccgtggtacgtaacgccttctggtacttacctacctttacgtaaaacgtaaccgttttaggccaagttcggccctacggtcggggtccccgaccgtaacggtcccgttacccggaacggggccggacggggggttccgtcggggtaagggttcgggggtgggtccgtaacggtttacgtccgttacgtagtaagtggaacgttaagggaaaaacgtttaaaaagtacgttaaggtttacggtactttaaccggttacggaacggggttaccgtaacgtttaccaacccgttaagttacctaacccgtaacggtaactaaacctaaacgtttaaccaaacgttaaaccgttccgttacggtaccgtaaactaaccgttaaactaaacgtacgtacctaaaccgttagtaccgtaaacgtaccggtaccggtaaaggacccgggtaacgtaacggttcgtttacgtaccgtttaaagttaccggtttacgggtacgggtacggggggtaaacgggggggttagggtttttaaccggttttcgggtaaccggttaccggtttaccgggtaaccccgtttggtttaaccgggtaccggtttacgggtacggggggtaaccccgtaaccgggg

SEQ ID NO: 174282 - DNA, 310 bp, Homo sapiens
  misc_feature: GYAE6OF02FIO28.49.65.F10.1.454.CMB.1.raw
  modified_base (148)..(148): a, c, t, g, unknown or other
  misc_feature (148)..(148): n is a, c, g, or t
  modified_base (265)..(265): a, c, t, g, unknown or other
  misc_feature (265)..(265): n is a, c, g, or t
  modified_base (267)..(268): a, c, t, g, unknown or other
  misc_feature (267)..(268): n is a, c, g, or t
  modified_base (270)..(270): a, c, t, g, unknown or other
  misc_feature (270)..(270): n is a, c, g, or t
  modified_base (272)..(310): a, c, t, g, unknown or other
  misc_feature (272)..(310): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggnggagggaccaagctgaccgtcctaggtcagcccaaggctcgccccctggtcactctcgttccccaccctccctctctctacgtcctgcgacgggccggtcgcggacgacgcactagngnngngnnnnnnnnnnnnnnnnnnnnnnnnnnnnnnnnnnnnnnn

SEQ ID NO: 174283 - DNA, 274 bp, Homo sapiens
  misc_feature: GYAE6OF02FWQNW.49.65.F10.1.454.CMB.1.raw
  modified_base (254)..(274): a, c, t, g, unknown or other
  misc_feature (254)..(274): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggaggacaagctgaccgtctaggtcagccaaggctcgccccctcggtcactctgttccccgcctcctctctctcgactctgacggcgggctggacaggcgacatgnnnnnnnnnnnnnnnnnnnnn

SEQ ID NO: 174284 - DNA, 903 bp, Homo sapiens
  misc_feature: GYAE6OF02IJT2H.49.65.F10.1.454.CMB.1.raw
  modified_base (152)..(152): a, c, t, g, unknown or other
  misc_feature (152)..(152): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttccncgttgcttcttttaagaggtgtccagtgtcaggtgcagctggtggagtcgtgggggagtcgtggtccagccgtgggacggtccctggacgtactctccgtggtagaacgccttcgtaggtacttcctaccgttacgaaacgtaacgttttcggactagtcggacctaacggtccggggtacccgtaccgaccggtcccttacccgaggggtaccggtaaccggggggtcttacggggtaacgggttgggggtacggtccgttaaaggttttaccgtacggtaccgaaggtagttaggtaagtaacgggtaaaaagttaaaaacgttaccggttaacgtttacccggtaccgttacccggttaagggaaaccggggttacccgtaaaccgtttacccgaaccgttacgttaacccgtaccgtaaacggtaaccgtaaaccgttaaaacgtttaacccggtaaaacggtaaacccgttaaaccccgttacgtaaccgttaaaccttaaccgttaaaacgtaaacgtaaccggtaaaccctacgttaaccggttaccgttaacgggtaaccggtaaccgttacggaaaccggtaaccgtaacggttaaccgttcggttaacgttaacgtttacggttacgggtacgggtaacggggttaacgggggttaaggtttacggtttacggtaacgtttacggttaaccggtaccgttacgttacggtaccggttacggtccggtacccggtaaccggg

SEQ ID NO: 174285 - DNA, 883 bp, Homo sapiens
  misc_feature: GYAE6OF02FZV1W.49.65.F10.1.454.CMB.1.raw
  modified_base (150)..(150): a, c, t, g, unknown or other
  misc_feature (150)..(150): n is a, c, g, or t
  modified_base (164)..(164): a, c, t, g, unknown or other
  misc_feature (164)..(164): n is a, c, g, or t
tcagagtcgagagacacgaccggtgctcgatttagctacgctctaaggggggtagaggagcccagcactagaagtcggcggtgtttccattcggtgatcagcactgaacacagaggactcaccatggagttggctgagctgggttttccngttgctctttaagnggtgtccagtgtcaggtcgcagcgtggtggacgtcgtgggggacggtcgtcgggtccagcccgttggggacggttcccctggaccgtacctccgtaccgtggtcgaaacggtcccttcgtgggtactttccaacccttcgtaaacggtaaccgttttcggctacttacggccgtaacgttcggggtccccgccacggtccctaccggacgggaccgaacgggggtcgtacgggtacgggttacgggtcggtacgtaacggttttaaccgtccgttaccaaggtacgttacggaacggttaagggtaaaacggtttaaaaaacggttaccgttaacgttacccgggtaaccgttaccggttaacgggaaccggggtacccgttaacgttacccgaacccgtacttacccgtaccgaacgtaaccgtaaaccgtaaccgttaaccctaaacggaaaccctacccgttacggaccctaacgtaccttaaaccgtaaacgttcgaaccgtaccgtacgtaccgtacgaaccgtaaccgtacgggtaaccggtaaccggtaaccggtacgttaaccggtttaacgttacgttacccggttaggtacgggtaccggggttaaaggggggttacgggttaacgttttacggtaccgttacgttaccgggtaacccctaggtttacccggacgtaaccggggttcgggtacccgggtaaccccgggg

SEQ ID NO: 174286 - DNA, 716 bp, Homo sapiens
  misc_feature: GYAE6OF02I1B5E.49.65.F10.1.454.CMB.1.raw
  modified_base (270)..(270): a, c, t, g, unknown or other
  misc_feature (270)..(270): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacggtccctgagactctcctgtgaagcctgtgattcaccttanaagtactttggcatgacacgtcgggtccgcacggcctccgaggcgacggggcgtggagtgggtggacgtagtttactcgtacagtagtacgtagtaagggtaaaagtttaaaaaacgtacgttaagtttaccgggtaaccttaccggttaagggaacgggtcccgttaacttacccgaccttaactccgtaacccgaagtaacgtaactaaacgttacccgaaaacgtaaaccctacttacgacctaacgttaacctaaactaaagtcgaacctaactacggtacgtacgaaccggtacctaggaacgtacgaacggtccttaagtacgttaacttcgtagtcgggaacgggtaagggggtaggtttacgtttacggacgttacggttaccggtacccgttacgttaccggtaccgttacgggtaccggggtacccgtaaccgggg

SEQ ID NO: 174287 - DNA, 311 bp, Homo sapiens
  misc_feature: GYAE6OF02IHM23.49.65.F10.1.454.CMB.1.raw
  modified_base (276)..(278): a, c, t, g, unknown or other
  misc_feature (276)..(278): n is a, c, g, or t
  modified_base (280)..(311): a, c, t, g, unknown or other
  misc_feature (280)..(311): n is a, c, g, or t
tcagagtcgagagacacgaccggtgctcgatttagctacgctctaaggggacacggccaccctgaccatcagcagggtcgaagccggggattgaggccgactattactgtcacgtgtgggacaggtagtagtgatcatggtggtgttcggcggagggaccaagctgaccgtcctaaggtcagcccgaaggcctcgccccccttcggtcctaccttctcgttccccacccttcctcctctctccgactctgacggcggctggcgaaggctacagtgnnncnnnnnnnnnnnnnnnnnnnnnnnnnnnnnnnn

SEQ ID NO: 174288 - DNA, 266 bp, Homo sapiens
  misc_feature: GYAE6OF02GFK33.49.65.F10.1.454.CMB.1.raw
  modified_base (252)..(266): a, c, t, g, unknown or other
  misc_feature (252)..(266): n is a, c, g, or t
tcagagtcgagagacacgaccggtgctcgatttagctacgctctaagggacacggccaccctgaccatcagccgggtcgaagacgggatgagccgactattactgtcaggtgtgggatagtggtagtggtgtcgtcttcggagctgggaccagggtcaccgtcctaggtcagcccaaggccaaccccactgtcactctcgttcccgccctcctctctctcgactctgaggcgggctggcaaggcgacatagnnnnnnnnnnnnnnn

SEQ ID NO: 174289 - DNA, 856 bp, Homo sapiens
  misc_feature: GYAE6OF02G78PD.49.65.F10.1.454.CMB.1.raw
tcagagtcgagagacacgaccggtgctcgatttagctacgctctaagggggggagaggagcccagcactagaagtcggcggtgttccattcggtgatcagcactgaacacagaggactcaccatggagtttgggctgagcttgggttttcctcgttgcttcttttaagaggtgtccagtgtcgaggtgcagctgggtggagtcggtggggggaggcgtggtccaggccgtggggacgtccctggacgtactccgtcctggtagaacgcctgtaggtacttccaccttacgaaagtaaccgtttggcctaagtcgacccgtacggttccggggtccccgccgaacggtcccgtacccggacggggcccggtaaccgggggtcgttagggggtgggttggggggtccggaccgtaaggtttaacgtccgttacgaacgggtattaggaaggtaaggggtaaaaaacgttaaaaacggttacgttaacggtttacgggtaacccttaccgggtttaagggggaaaccggggtcccttaaacggttccctaaccgtacgtacccgttaccgaaacggtaaccggtaaacctaaaccgttaacccgtaaaaacggaaccttaacccgttacgtaacctaacttaacctaaacgtaactacggtaccctaacggtacgtacgtacgtaacgtaccgtacgggtaaccggacggtaaccgtagttacgttacgttaacgtacgttcgggtagggtacggggggtaaggggttaacgggttagttttcggaaccggttacgttaccggtaccccgttacggttaccggtacggttaccgggtcgggtaaccccggtaacccggg

SEQ ID NO: 174290 - DNA, 698 bp, Homo sapiens
  misc_feature: GYAE6OF02GVNHF.49.65.F10.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (491)..(491): a, c, t, g, unknown or other
  misc_feature (491)..(491): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtggggacgtccctgacgactctcctgtgaagcctntggattccaccttnaagtaactttggacagtgcctacgtcgggtccgccaggcctccgaggccgacggggctgggaggttggggcggctacggtttatcgtacgagtacgtaggtaagtagggtaaaagttaaaagtcttaagtttaccggacctttccgtaagggaacgggcctaattcccaacctagtcctaccagaacgaactaacttacccgaaagtaacctaccttanaacctacttacctaaacgaaacttagaccacgtacgtccgtagaacgtaccgtaggaacgaacgaccgggtacttaggttacgttaacgtttacgtaggtacgggaccggggtaaggggggttacgggtttagttttacggcgttaacgttccggtaaccgttacggttacggtaccggtaccggtaccggggtaccgtaaccgggg

SEQ ID NO: 174291 - DNA, 289 bp, Homo sapiens
  misc_feature: GYAE6OF02GP4AM.49.65.F10.1.454.CMB.1.raw
  modified_base (262)..(289): a, c, t, g, unknown or other
  misc_feature (262)..(289): n is a, c, g, or t
tcagagtcgagagacacgaccggtgctcgatttagctacgctctaaggggacacggccaccctgaccatcggagcagggtcgaaagccggggatgaggccgactattactgtcacgtgtgggacagtagtagtgatcatgtggtgttcggcggagggaccaagctcgaccgtcctaggtcagcccaaggctcgccccctggtcactctcgttcccaccctcctctctctcgactcgtgagcggctaggcaacggcgacatgnnnnnnnnnnnnnnnnnnnnnnnnnnnn

SEQ ID NO: 174292 - DNA, 525 bp, Homo sapiens
  misc_feature: GYAE6OF02F3KZL.49.65.F10.1.454.CMB.1.raw
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (330)..(331): a, c, t, g, unknown or other
  misc_feature (330)..(331): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (368)..(369): a, c, t, g, unknown or other
  misc_feature (368)..(369): n is a, c, g, or t
  modified_base (372)..(373): a, c, t, g, unknown or other
  misc_feature (372)..(373): n is a, c, g, or t
  modified_base (375)..(376): a, c, t, g, unknown or other
  misc_feature (375)..(376): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (388)..(389): a, c, t, g, unknown or other
  misc_feature (388)..(389): n is a, c, g, or t
  modified_base (391)..(392): a, c, t, g, unknown or other
  misc_feature (391)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(419): a, c, t, g, unknown or other
  misc_feature (417)..(419): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtagttgggcgggagggacctaagctgaacccgttcctaggtcacgcccaaggtctcgcccccctggtaccactcttcggttccccacccttcctcctccgtactccgtaccttctcggaacggtccccgggtcgttcggaccgacggaccgtactaagccgtgctnantncagcngtgactangtagnanngntgtntacgcgntanagatagtagtnacacatncgnngannanncnctcncnancnngnntntntgancngtncagancancncnnngnacngtnagcacgcgtcgngtacgaccgtaccgtacctaccgtgcgacggactcgacgcgtaccgaccttacgttaagtacgttcggtacggttaacgtaacgcg

SEQ ID NO: 174293 - DNA, 515 bp, Homo sapiens
  misc_feature: GYAE6OF02ICHY5.49.65.F10.1.454.CMB.1.raw
  modified_base (142)..(142): a, c, t, g, unknown or other
  misc_feature (142)..(142): n is a, c, g, or t
  modified_base (192)..(192): a, c, t, g, unknown or other
  misc_feature (192)..(192): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
tcagagtcgagagacacgaccggtgctcgatttagctacgctctaagggcgacgaccggtgctcgatttagctacgctctaggggacacggccaccctgaccatcagcagggtcgaagccggggatgaggccgactattacngtcacgtgtgggacagtagtagtgatcatgtggtgtcgcggaggaccaanctgaccgtctaggcacgccaagctcgccctcggtcactctacgtccccacctcctgtctcgctatctggacggcggactggacgacgcaactgagcnacgcttanagctnaacgctntaacgncgaacgcanctagntcggatgagcagntcncggntcgatggccntcgtaancgacttggacacgngaanttaacggncttcaaggcgttacgnacactcacgacgacgctacgcgacgacgtcgtcgtacgactacgtacgtcgtacgtacgcgtctacgtacgacgtacgacgacgtacgacgtacgactacgacgtcg

SEQ ID NO: 174294 - DNA, 342 bp, Homo sapiens
  misc_feature: GYAE6OF02J0WKD.49.65.F10.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (267)..(342): a, c, t, g, unknown or other
  misc_feature (267)..(342): n is a, c, g, or t
tcagagtcgagagacacgaccggtgctcgatttagctacgctctaaggggacacggccaccctgaccatcagcagggtcgaagccggggatgaggccgaccttattactgtcacgttggtggacagtagtagtgatcatggtgtgtcggnggaggcaagctgccgtcctaggtcagcccaaggcctcgccccgtcgtcnctctcgttcccncctcctctctcctcgcttnggcggcgggtctacggtacgaagggtcactagtagcnnnnnnnnnnnnnnnnnnnnnnnnnnnnnnnnnnnnnnnnnnnnnnnnnnnnnnnnnnnnnnnnnnnnnnnnnnnn

SEQ ID NO: 174295 - DNA, 591 bp, Homo sapiens
  misc_feature: GYAE6OF01A00N2.34.39.D06.1.454.CMB.1.raw
  modified_base (247)..(247): a, c, t, g, unknown or other
  misc_feature (247)..(247): n is a, c, g, or t
  modified_base (541)..(541): a, c, t, g, unknown or other
  misc_feature (541)..(541): n is a, c, g, or t
tcagtacacgtgatcacgaccggtgctcgatttagtgacatctcgcagttcggtttggggctctgcttcagctgtgggcacaagaggcagcacgtcaggacaatctccagcatggccctggtctcctctcctcctcactctccctcgctcactgcacagggtcctgggcccagtctgtcctgactcaggctgcctccgtgtctgggtctcctggacagtcgatcaccatctcctgcactgtaaccgnagtgaccgttgatgattactaagtctgtctctggtaccaacacacccgacaacgttcccaaactcatagtatttatgatcgtacaaattacgtcggtaccctcgtacggttctttacctcattccgtcttctcctcgtccctcctacttggtcctaggacctaaccgaccggtcccttccctacggtaccctactcctaccgtcggacctcccgaggcctaggacgggtacgagggttcacggacccgaaggccgtccgccccgttcggtaccgtacctcgttaccgtaccccncccgttcctactaccgtccgtaccgtacgttaccgtggtccgggtcccgg

SEQ ID NO: 174296 - DNA, 587 bp, Homo sapiens
  misc_feature: GYAE6OF01ERYBB.34.39.D06.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (406)..(406): a, c, t, g, unknown or other
  misc_feature (406)..(406): n is a, c, g, or t
tcagtacacgtgatcacgaccggtgctcgatttagtgacatctcgcaggttctttggggctacgtgcttcagctgtggcacaagaggcagcactcaggacaatctccagcatggcctggtctcctctcctcctcactctcctcgctcactgcacagggtcctgggcccagtctgtcctgacgcagccgccctcactgtctggggccccccgaagagngtccacatctccngcacgtcggggcacctccaacagtcgggctaggttttgttcgtacactggtaccagcagtacgtacccggaacaccgacccctaactcctctattcgtttacgtaacaactacgtccgccctcgacgggtccctcgtaccgtactttctcgcctaccgtaacgtctcgccacctcncgtccctccgtgactattagtcgacctccgacgtcctggagtgtgacgtctagtattattacgtgtcacgtacactgtacgaaccaaccgtacccggtcggggtccgggtcgttaccggggcgggtaacggaccgtaacgccgtacggacccgttcctacgacgtccgacggcccgaacgg

SEQ ID NO: 174297 - DNA, 528 bp, Homo sapiens
  misc_feature: GYAE6OF01C062G.34.39.D06.1.454.CMB.1.raw
  modified_base (211)..(211): a, c, t, g, unknown or other
  misc_feature (211)..(211): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtctcggggcccccganagagagtcaccatctcctgcacgtgggggcacctccaacatcggggcaggttttgtgtacactggtaccagcagattcccggaacacgcccccaaactcctcatctttggtaacaacaatccggccctcgacggggtccctgaccgtattttctggtctccaagtctggccacctcacgccctccctggccatcactgggcctccgggctggaggatgaggctgatttattactgtctagttcctttgactagcagtcctgagtgtcttagtgttcttcggaactgggacctaggtccaccgtcctaggtcaaccgg

SEQ ID NO: 174298 - DNA, 523 bp, Homo sapiens
  misc_feature: GYAE6OF01EHSPD.34.39.D06.1.454.CMB.1.raw
  modified_base (213)..(213): a, c, t, g, unknown or other
  misc_feature (213)..(213): n is a, c, g, or t
  modified_base (366)..(366): a, c, t, g, unknown or other
  misc_feature (366)..(366): n is a, c, g, or t
  modified_base (424)..(424): a, c, t, g, unknown or other
  misc_feature (424)..(424): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtctcggggccccccganagagagtcaccatctcctgcacgtgggggcacctccaacatcggggcaggttttgtgtacactggtaccagcagattcccggaacacgcccccaaactcctcatcttggtaacaacaatccggccctcgacggggtccctgaccgtattttcncgcctccaagtctggcacctcacgccctccctgactattattcggactcagcctgagntgagctgattatactgtcagtcacatgacaacgaccgtgggccgggtcgtcgggcggagggaccaggcctggacccgtcctacagtcagcccgtaacgg

SEQ ID NO: 174299 - DNA, 663 bp, Homo sapiens
  misc_feature: GYAE6OF01C7Y0Y.34.39.D06.1.454.CMB.1.raw
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgcctcactgtctcggggcccccggacagagagtcaccatctcctgcacgtgggggccacctccaacatcggggctaggttttgttgtacactggtaccagcagacttcccggaacacgccccaaactcctcatctttagtaacaacaatcggccctcacgggtccctcgaccgtatttctcgtcctccaacgtctcggcacctcacgccctccctggcccactccacgtcgggccctccgggctggacggatggacgggtcctggtaacttttacttaccgttcgttcgtacggtttcccttttaggaccgtaggcctaacggtcccgttaggacggttcgttctttaacgttcggtttacccgttttaccggggtaaaccgttcgggggtaaaccccctaacggggttacccctaccccgggtttacccgttaccggggtacccaaccgggtaccccccgtaaagggtaaacccccccccg

SEQ ID NO: 174300 - DNA, 613 bp, Homo sapiens
  misc_feature: GYAE6OF01BE1WR.34.39.D06.1.454.CMB.1.raw
  modified_base (211)..(211): a, c, t, g, unknown or other
  misc_feature (211)..(211): n is a, c, g, or t
  modified_base (442)..(442): a, c, t, g, unknown or other
  misc_feature (442)..(442): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgcctcactgtcgtcggggcccccganagagagtccaccatcctcctgcacgtgggggcacctccaacagtcggggctaggttttgtgtacactggtaccagcagacgttcccggaacacgacccccaaactcctacacttctttaggtaaaccaacaactccggccctcgacggggtccctgaccgtatttctcgccctccgaagtctggccacctcacgccctccgtggactattatcggactccagcctgacggntggaggtctagtatttacttacgtcgtactacgttaccacgtatacgaaccgaaccgtacccgggtcggggtaccggggtccgtttacggggaccggggtacgggaacccgtaacggcccgttacggaccccgttcgtacgtacggtaccgaccggtacccgtaacccggg

SEQ ID NO: 174301 - DNA, 687 bp, Homo sapiens
  misc_feature: GYAE6OF01DBVT5.34.39.D06.1.454.CMB.1.raw
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggcccccggacagagagtcaccatctcctgcacgtcgggggcacctaccaacagtcggggctaggttttgttgtacacgtggtacagcagacttcccggaacacgaccccaaactcctactactcgtttagtaacaacaactccggccctcgacggggtccctgaccgtattcctcgtacggtcctacgtaacgtcgtcggacctaccctacgacgtcccctacccgtcggccctaacgtccgtaccggtcgggtcccgtcccggggtacttacgggaacggtagtcgggtacgtcgttacggttaaacctttacttaaccgttggtaccgcgaaccggtcgtaaggtcgggtaatacgacgacggtcccgttaggaaccgttgggtacccttaccgttaggttcggttacccggtttaacgggaaccggttaacgggtaacccggtaacggttccccgtaaaccggttcccggttaacgggtaacccg

SEQ ID NO: 174302 - DNA, 517 bp, Homo sapiens
  misc_feature: GYAE6OF01EGA7W.34.39.D06.1.454.CMB.1.raw
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtctggggcccccggacagagagtcaccatctcctgcactgggggcacctccaacatcggggcaggttttgttgtacactggtaccagcagattcccggaacacgcccccaaactcctcatctttggtaacaacaatcggccctcgagggtccctgaccgatttctgcctccaagtctgcacctcagcctcctggactattatggactcagcctgaggatgagctgattattactgtcagtcacatgacaacaccgtgggcgggtcttcgggcggagggaccaaggctggacccgtctcagtcaacgcccaaggcctcggtcccccg

SEQ ID NO: 174303 - DNA, 598 bp, Homo sapiens
  misc_feature: GYAE6OF01D6B6T.34.39.D06.1.454.CMB.1.raw
  modified_base (441)..(441): a, c, t, g, unknown or other
  misc_feature (441)..(441): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggccccccggacagagagtcaccatctcctgcacgtgggggccacctccaacatcggggcaggttttgttgtacactggtaccagcagattcccggaacacgccccccaaactcctcatctttggtaacaacactccggccctcgacggggtccctgaccgtatttctgtccctccaagtctcggcctacctcacgtccctcccgtggactatttagttcggacctcccgagccctggacggntggacggtctgtatttacttactgtctacgttcctttagacctagccacgtcctgtacgtgtcttaagtcgttccgttacgggaacgttcggggaaccctaagggtccctacccggtccgttacgggtaccaccggtacccgaacgggtaacccccc

SEQ ID NO: 174304 - DNA, 391 bp, Homo sapiens
  misc_feature: GYAE6OF01BE1C9.34.39.D06.1.454.CMB.1.raw
  modified_base (239)..(239): a, c, t, g, unknown or other
  misc_feature (239)..(239): n is a, c, g, or t
  modified_base (383)..(391): a, c, t, g, unknown or other
  misc_feature (383)..(391): n is a, c, g, or t
tcagtacacgtgatcacgaccggtgctcgatttagtgacatctcgcacctccaacatcggggcaggttttgttgtacactggtaccagcagattcccggaacagcccccaaactcctcatctttggtaacaacaatcggccctcaggggtccctgaccgattttctgcctccaagtctggcacctcagcctccctggacattattggactccagcctgaggatgaggctgattattacngtcagtcacatgacaacacctggcggggtcttcggcggagggaccaagctgaccgtcctcagtcagcccaaggctcgccccctcggtcactctcgttcccacctcctcatcacgtgtactgagcggctggcaaggcgcagtagnnnnnnnnn

SEQ ID NO: 174305 - DNA, 535 bp, Homo sapiens
  misc_feature: GYAE6OF01CJ8C8.34.39.D06.1.454.CMB.1.raw
  modified_base (205)..(205): a, c, t, g, unknown or other
  misc_feature (205)..(205): n is a, c, g, or t
  modified_base (461)..(461): a, c, t, g, unknown or other
  misc_feature (461)..(461): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
tcagtacacgtgatcacgaccggtgctcgatttagtgacatctcgcagttctttgggggctcagctgtgggcacaagaggcagcactcaggacaatctccagcatggcctggtctcctctcctcctcactctcctcgctcactgcacagggtcctgggcccagtctgtcctgacgcagccgccctcactgtctgggcccccgganagagagtcaccatctcctgcacgtgggggcacctccaacatcggggctaggttttgttgtacactggtaccagcagacttcccggaacacgacccccaaaactcctacatctttagtaacaaacaatccggccctcgacggggtccctagaccgtatttctcgcctccaagtctggcacctcacgccctcctggactattagtgactcagcctagaggatggagctagatttatactgtcagtcacatgaacaacnccgtgggcgggtcgttcggcggaggaccgaagtcncggcctcctnacgtcacgcccgaaaggcctcgtcccccg

SEQ ID NO: 174306 - DNA, 696 bp, Homo sapiens
  misc_feature: GYAE6OF01CFPB3.34.39.D06.1.454.CMB.1.raw
  modified_base (214)..(214): a, c, t, g, unknown or other
  misc_feature (214)..(214): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggccccccganagagagtccaccatcctcctgcacgtggggcacctccaacagtcggggctaggttttgtgtacactggtaccagcagacttcccggaacacgcccccaaactcctcatctttaggaacaacaatccggccctcgacgggtcccctagaccgtattttctcgccttccaagtcgtcggcacctcacgtccctcccttcggactagtttacttacggacctcccgaacgtccctaggacggacgtcggaacggtccttagtaacttttaacgtttaccgttacggttaccgtacgttaccaacgtaacgttacgaacccgaaacccgtaaccccgggttcggggggtacccgggggtttaccggtttacccgggggacccggggtaacgggggtaaccccgtaaagggttcccgtaccggttaacccccgggttcccttacccggaacggtttccccgaaacgggtcccccggtaaacccgggg

SEQ ID NO: 174307 - DNA, 568 bp, Homo sapiens
  misc_feature: GYAE6OF01AFYKN.34.39.D06.1.454.CMB.1.raw
  modified_base (214)..(214): a, c, t, g, unknown or other
  misc_feature (214)..(214): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggcccccgganagagagtcaccatcctcctgcacgtgggggcacctccaacatcggggctaggttttgttgtacactggtaccagcagattcccggaacacgcccccaaactcctcatctttaggtaacaacaactccggccctcgacggggtccctgaccgtattttctcgcctccaagtctggcacctcacgtccctccctcggactattatcgtacctccagcccgtgaggatggaggctgatttattactgtcacgttcacatagaccaacgtcccgtggggccggggttcgttaccggggcggaacggggaccaaggccgtacggacccgttcctacgacgtccacggcccgtaaccggg

SEQ ID NO: 174308 - DNA, 603 bp, Homo sapiens
  misc_feature: GYAE6OF01DRFNE.34.39.D06.1.454.CMB.1.raw
  modified_base (214)..(214): a, c, t, g, unknown or other
  misc_feature (214)..(214): n is a, c, g, or t
  modified_base (386)..(386): a, c, t, g, unknown or other
  misc_feature (386)..(386): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtccgtcggggccccccganagagacgtccacctatcctcctgccacgtgggggcacctccaacagtcggggctaggttttgtgtacactggtaccagcagacttcccggaacacgacccccaaactcctcacttcgtttaggtaaaccaacaagtccggccctcgacggggtcccctgtaccgtattttcncgtcctcctaagtctggcaccctcacgtccctcccgtggactatttagttcgacctccgagccgtgtacggagtcgagtctgtattattacgtgtctacgtcactatacgactaaccgtcccgtggggtccgggttacgttcggggaccggtaagggaacctaacggcctacggtaccccgttacctacgaggttaccacggtccccgtaaaccggg

SEQ ID NO: 174309 - DNA, 656 bp, Homo sapiens
  misc_feature: GYAE6OF01A7WPI.34.39.D06.1.454.CMB.1.raw
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (294)..(294): a, c, t, g, unknown or other
  misc_feature (294)..(294): n is a, c, g, or t
tcagtacacgtgatcacgaccggtgctcgatttagtgacatctcgcagttctttggggctctgcttcagctgtgggcacaagaggcagtactcaggacaatctccagcatggcctggtctcctctcctcctcactctcctcgctcactgcacagggtcctggcccagtctgtcctgacncacgccgccctnactgtcgtcgggggcccccganagagagtccaccattcctccngccacgtcggggccaccctccaacagtcgggctaggttttcgttgtacacgtcggtaccngcagactaccgaacacgaccccaactcctcacttcttagaacaactaactccggtcctcgtacggggtccctcgtaccgtacttttctcgtccctacacgtacgtcggcctaccgtcacgtccctcccgttagacttaacgttacgtcggacctacgacgtccgtagaacggtacgtcggacggtcttacgtactttacttacgttcgtacctacggtactaacgtaacgttacgaaccgtacccgtacccgggttcggggtccggggttaccggttccgggaccgggaaccggaacccgtaacggccgtaaccgtcccgttaccgtacgacggtacccgacggtcccgaaccgggtccccg

SEQ ID NO: 174310 - DNA, 933 bp, Homo sapiens
  misc_feature: GYAE6OF01A25D2.34.39.D06.1.454.CMB.1.raw
tcagtacacgtgatcacgaccggtgctcgatttagtgacatctcgcagtttcgtttgggggctctgcttcagctggtgggcacaagaggcagcactcaggacaatctccagcatggcctggtctcctctcctcctcactctcctcgctcactcgcacgacgggtccgtcgggccctagtctgtcctgacgcacgcccgccctcactgtccgtccggggcccccgagagagacgtccaccactcctccgtcgaccgtacggtcgggggacccaccctaccaaaccgacggtccgggggtacgttaaggggtttttcggttacgttaaccgtaccgttacgggtaacccgacgaccgaacggtaccgttaccccgggaaacgacccggtaacccccctaaaaccttccctactactttaccgttttaacggtaaaacctaaaccgtaaaccgtcccgggtaccccgttacgggtaacccgggggttccccgtaccggtaacccgtttacgtttttccgtaccgtaccccttaccgtaacggttcccgtacgggaccctacccgtaccgtaccgtcccccgttacccggtacggtaacctttaacgtttacgttaccggtaacccgttacccgtacggtaccccgttagggtaacggtacggttacgggtacgggttaccgttaagttaaccgtttttaacgtttaaccggtttaccgtttaccggtttaacccggttttacccggtttttaacggaaccggtaccgtaccggtaaccggttcccggttagggttaacggtttccgttacggttttaacggttccggtttaacccggttaaccgggggtaaccggttaaccggggtaaacccggttaaaccgggttacccgttaaccccggttaccgggttaccgggtacccggtaaacccccggg

SEQ ID NO: 174311 - DNA, 917 bp, Homo sapiens
  misc_feature: GYAE6OF01AB8GD.34.39.D06.1.454.CMB.1.raw
tcagtacacgtgatcacgaccggtgctcgatttagtgacatctcgcagttctttgggggcttcagctgtgggcacaagaggcagcactcgaggacaatctccagcatggcctggtctcctctcctcctcactctcctcgctcactgcacgtacggtccgtcggcctagtctcgtcctgacgcacgcccgccctcacgtgtccgtccggggcccccgacgagagacgtccaccactcctccgtcgccgtacggtcgggggccacccgtaccaaccgtacggtccggggtacgttacgggtttttcgttacggtaacctacgttacgggtaaccacggtacgaacggtaccgttaccccgggaaaccacccggtaacccccctaaaaccttccccgttaccgtaaccttttaccggttttaaccgggtaaaaccctaaaccgtaaaccgttccccgggtaccccgttaccgggtaacccgggggtttaccccgtaccggtaaacccgttttacttttccgtaccggtaccccgttaccgtaaaccggttccgttaccgggacccttaacccgtccgtaaccgtccccttacccggtacggtaaccttacgtttacgttaccggtaccctaccgtacgtccgtaggaacggtagtacggtacggtcctaggttaactttacggtttaccgttacgggtaccctaacggtacctaaccggtacgttaacccggaaacccgttaaacccggttcccggggttacggggggtaacccggggtttccggttaccgggggaacccggggtaaaccgggtaaccccgggtaaacgttcccgggtaacccggttacccggttacccgtacggtaccggtacccgacccggtacccggaaccgggtcccgtccccggttaccccccgg

SEQ ID NO: 174312 - DNA, 388 bp, Homo sapiens
  misc_feature: GYAE6OF01CJMNA.34.39.D06.1.454.CMB.1.raw
  modified_base (248)..(248): a, c, t, g, unknown or other
  misc_feature (248)..(248): n is a, c, g, or t
  modified_base (375)..(388): a, c, t, g, unknown or other
  misc_feature (375)..(388): n is a, c, g, or t
tcagtacacgtgatcacgaccggtgctcgatttagtgacatctcgcacctccaacatcggggcaggttttgttgtacactggtaccagcagattcccggaacagcccccaaactcctcatctttggtaacaacaatcggccctcaggggtccctgaccgattttctgcctccaagtctggcacctcagcctccctggacattattggactccagcctgaggatgaggctgattattactgtcagtcanatgacaacacctgggcgggtcttcggcggaggaccaagctgaccgtctcagtcagccaaggctcgcccctcgtcactctgttcccgcctctcatcacgtgtactgagcggctggcaaggcgcatagnnnnnnnnnnnnnn

SEQ ID NO: 174313 - DNA, 780 bp, Homo sapiens
  misc_feature: GYAE6OF01BIW66.34.39.D06.1.454.CMB.1.raw
tcagtacacgtgatcacgaccggtgctcgatttagtgacatctcgcagttcgtttgggggcttcagctgtgggcacaagaggcagcactcaggacaatctccagcatggcctggtctcctctcctcctcactctcctcgctcactgcacagggtcctgggcccagtctgtcctgacgcacgccgccctcactgtccgtccggggcccccggacagagacgtccgaccatcctcctgcgtacgtcgggggaccaccgtaccaacgacgtccggggtacttaggttttcgttgtaccgtacgtacggtaccagcgtacgtacgttacccggaacaccgaccccctaaacctccgtactactttaccgtttacggtaaacctaaacgtaacgttcccggtacccgtaccggtaaccgggggttacccgtacggtaacccgttacgttttccgtacgtcccctaacgtaacgtccgtacggacctaccctcgtaccgtcccgttcccgtacgacctagtttacgtcgaaccttcccgacgtacctaggtacggagttcggaggttaccgttagttaactttacgtttacgtcgttacgtaacgttacaacgtactaccgtaacctaacccggtacccgggtacggggtccggttaccgggttaccggggacgggtaaaccgggaacccgtaacggtacccgttaccgggtaaaccccgtttcccgtaaccgtacggtaccgacccggtacccggtaacggtccccgttcccggtaaccccccgg

SEQ ID NO: 174314 - DNA, 694 bp, Homo sapiens
  misc_feature: GYAE6OF01AF8L1.34.39.D06.1.454.CMB.1.raw
  modified_base (381)..(381): a, c, t, g, unknown or other
  misc_feature (381)..(381): n is a, c, g, or t
  modified_base (461)..(461): a, c, t, g, unknown or other
  misc_feature (461)..(461): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctcgggcccagtctgtcctgacgcagccgccctcactgtccgtccggggcccccgacagagagtcaccatcctcctgcacggtgggggcctacctaccaacgagtcggggtctaggttttgtcgtacacgtacggtaccagcagtacttacccggaacaccgaccccaactcctactattttacgaacacaacgtccgacctcgacgggtcctacgtacctatttcncgtcctaccacgtctcggcctacctcgtactccctccgtagacctattacgtcggtacctccgtacgtcgtggaacggtntacggtacggtaccttagttaactttacgtttacgtgttaccgtacgtacctaatacgtacgtaaccccgaaaccggtaccccgggttcgggggtacccgggttaccggttaccggggaccgggtaaccggggtaacccgtaacgggtcccgtacccggttacccggtcccgttacggtaaccgtaccgtacccggacccggtaacggcccttccccggtccccgttacccgg

SEQ ID NO: 174315 - DNA, 780 bp, Homo sapiens
  misc_feature: GYAE6OF01C4U6H.34.39.D06.1.454.CMB.1.raw
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacgacgggtcctcgggcccagtcttcgtcctcgaccgcacgcccgccctcacgttcgccggtccgggggcccccgagaggagacgtccacctactcctcctggccgacggtcgggggccaccgtaccgaacgacgtcggggtactaggttttgttcgtactacgtacggtaccagctacgtacgttaccggaaccaccgacccctaaactcctactacttacgtttacggtaaaccaacgtaacgtccggtccctacggtaccggggtccctacggtaccgtttacgttttccgccgtacccgttaccgtaacgtccgttcggaccctaccgttaccgaccgtccccgttacccgtacgtaacttacgtttacgttacggacccttaccgtacggtaccgtcggtaggacggtacggacggttacttagttacttttaacgttacgttacgttccgtaacgttaccactacgtaccggtaccgtaaccgttacccgggttcggggtacccggggttccggtaccgggggaaccggggtaaccggggtaacccgtaacgggcccggtttaccggtacccgttacccgtacgttaaccggacccgtaaccggtaccccggtaaacccgggg

SEQ ID NO: 174316 - DNA, 656 bp, Homo sapiens
  misc_feature: GYAE6OF01BRETU.34.39.D06.1.454.CMB.1.raw
  modified_base (622)..(622): a, c, t, g, unknown or other
  misc_feature (622)..(622): n is a, c, g, or t
tcagtacacgtgatcacgaccggtgctcgatttagtgacatctcgcagttctttggggctgagagaggagcccagccctgggatttcgggtgtttcacttggtgatcaggactgaacagagagaactcaccatggagtttggctgagctggtcttttctgtggtcttatttaaaggtgtaccaatgtgaggtgctagctgttggagtcgtggggagtacttacggtacgacgggcccgggggggtcctaggacgtacctcgtcctagtaaacgcctcgtggtactccgtacctttcgaccctaaagtcgtcgccgttcgtccgtcgggtcccgcgacggtcctaccggaggaacggcggtacgtggtacggtcggtcgtcgtcgtacttaagttagtagaacgtagtacggtacggtacctaacaccctactacgaactacgtaccgtccgtaaggaccggtacccgtacccacctacgttaccaccgagtaacgacctaacgttacaacgacgtaccacgtacgttacgtacgttcgtacggaccacgtacgaacgacgtacctaaggaacgacggaccggtacgaccgtaccggactagtacgtacgtgacgacgacacncactcgtgcgtctacgtatcggatacgggtcggg

SEQ ID NO: 174317 - DNA, 627 bp, Homo sapiens
  misc_feature: GYAE6OF01E41PF.34.39.D06.1.454.CMB.1.raw
  modified_base (212)..(212): a, c, t, g, unknown or other
  misc_feature (212)..(212): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtctcggggccccccganagacgagtccaccatcctcctgcacgtggggcacctccaacatcggggctaggttttgttagtacactggtaccagcgagacttacccggaacacgaccccaaactcctcatctttagtaacaacaatcggccctcgacgggtcctgaccgtatttctcnccctacgacgtcgtcgcctaccncacgtccctaccgtacgtaacttagttacgtacgtccctaccgtacgtccgtaggacggtagtacggtacgtcgtacgttaactttacttacgtactacgtacgtacctactagtaccgaaccgtaacccgtaccgggtcgggtaccggggttacgtacggggtaccgggacgggaaccgaagtcccgtacgtaccccgtaccgtacgtaagccgtaccgccgtaacccggg

SEQ ID NO: 174318 - DNA, 756 bp, Homo sapiens
  misc_feature: GYAE6OF01CEDVG.34.39.D06.1.454.CMB.1.raw
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcacgccgccctcactgtccgtcggggccccgacagagagtccaccactcctcctgcacgtcggggccacctaccaacgacgtcggggtcttaagggttttcgttacgtactacgtcggtaaccagcacgtaacgttaccccggaacaccgacccccctaaactccctactatttccgtttaggtaaaccaaactaacgtcccggacccgttacggtaccgggggtccctacgtaaccgttacttttccgtacgtccccttaccgaacgtcgtaccgtaccgtaccctcgaccgtccctaccgttgtaaccttagtttacgtacgggtaccctaccgtacgtcccgttaggacggtagtagggtaaccggtcgttaacgttaactttttaacgtttaacgttcggttaccgttaaccgttttacccggtttacggaccgtaccggtccgttaaccggtcccgttagtaaccggtttgtaccgtttacgtacggttaccggttaacgtaaccgggtacggtaaccgtaccggtacccgtcccggtaccgtacggtaccaacccgcccggaaccgtacccccg

SEQ ID NO: 174319 - DNA, 708 bp, Homo sapiens
  misc_feature: GYAE6OF01C3ET3.34.39.D06.1.454.CMB.1.raw
  modified_base (269)..(269): a, c, t, g, unknown or other
  misc_feature (269)..(269): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacgagggtcctcgggcccagtctgtcctgacgcacgcccgccctcactcgtcgtcggggcccccggacaggagacgtcacctatctcctgcacgtcgggggccacctaccaacagtccggggntagggttttgtcgtactactggtaccagccagtacgttacccggaactaccgaccccctaaactcctactaatttcctttaacggaaacctaaactaacgtccggtacccctacggtaccggggtccctacgaccgtttacttttccgtccgtaccctaccgaaggttccgtcggacctaccgtccgaccgtccctaccgttacggacttagtttacggtcgtaccgtaccccgtacgtcccgtagggaacggtacgtagggcggtacttgtaacttttacgttacgtacgttcgacgttaccacgtacgtacgaaacccaccgtacccgggttggggtacccggggtcgttccggggacgggtacggaaccccgtacggtaccgtcggacccttccgtctacggccacccgacgaccggtccgtccccgtacccccgg

SEQ ID NO: 174320 - DNA, 725 bp, Homo sapiens
  misc_feature: GYAE6OF01AVOTP.34.39.D06.1.454.CMB.1.raw
  modified_base (518)..(518): a, c, t, g, unknown or other
  misc_feature (518)..(518): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagcccgccctcactgtcgtcggggcccccggacagagagtccaccatctcctgcacgtgggggcacctccaacgagtcggggctaggttttgttgtacacgtggtaccagctagtattccgtacggaaccaccgaccccctaaacctcctactacttacgtttaacggtaaacctaaactaacgtcccggaccctaccggtaccgggtccccgtacgtacccgttacttttcgtaccgtccctaccgaacgtccgtcggtacctaccctcaccgtccctccgtaggaacttagtttacgttcggaccctcgacggtcctagggagtacgtagggaccgttntacgtaacttttaacgtccgtcgttacgacgttccgaactacgtccgtaaacccgaacccggtcccggggtaggggggtccccgggttacgttaccgggggaccggggtaaaccgggaaccctaagggtccgtaccggaacccccgttccggtacgaccgggttaacccaaccgggtaccctaacggggttcccctacccccccggg

SEQ ID NO: 174321 - DNA, 770 bp, Homo sapiens
  misc_feature: GYAE6OF01AOBAC.34.39.D06.1.454.CMB.1.raw
tcagtacacgtgatcacgaccggtgctcgatttagtgacatctcgcagttcgtttggggctctgcttcagctgtgggcacaagaggcagcactcaggcaatctccagcatgcctggtctcctctcctcctcactctcctcgctcactgcacgacggtcctgggcccagtctgtcctgacgcacgccgccctcactgtccgtcggggccccccggatagacgacgtccaccatcctccgtgcctacgtcggggaccacctaccaacagtaccggggcgttacggttttcgttcgtacctaccgtggtaacccaggtccgaacgtaccgttacccgggaacaccggtaccccctaaacgtccctacgtaactttacctttaacgggtaaaccctaacgtaacgttcccggtacccgttccggtaaccggggttcccgtacgtacccggttaacgttttacccgtcgttaccccgtacccgtaaacggtttaccgtccggtacctacccgtacgtacccggtaccccgttcccgtacgggtaacctttacgtttaacggtacggtacctaccgaggtcccgtaggtagtacttgggacgtactacgttaactttagttacgtcgttacgtacgttacacgttactacggtaacctaacccggtccggttcggggtcccggttacggttaccgggaccgggttaacgggacgtaaccggtccgttacccggaccgttaccctacgaggtacctaaccggcccggttaacccggg

SEQ ID NO: 174322 - DNA, 797 bp, Homo sapiens
  misc_feature: GYAE6OF01CWGXZ.34.39.D06.1.454.CMB.1.raw
  modified_base (216)..(216): a, c, t, g, unknown or other
  misc_feature (216)..(216): n is a, c, g, or t
tcagtacacgtgatcacgaccggtgctcgatttagtgacatctcgcagttctttggggctctgcttcagctgtgggcacaagaggcagcactcaggataatctccagcatgcctgtctctctcctcctcactctcctcgctccactgacacacgggtcctgggccagtctgtcctgacgcacgtcccgcctcacgtgtccgtccggggcccccganacgagacgtcacctatccgtcctgccgacggtcggggccaacctaccgaacgtacggtccggggtaccttagggtttttcgttacgtaactccggttacggtaccgaacgacgtacgtaccgtttaccccggaaaccaccccgtaaccccctaaacttccctactacttacggtttacgtaaaccgtaaacctaacgttcccggaccctaccggtacgggttccccgtacgtacccgtttattttccgccgtcccgtaccgtaacgtcgtccgtaccctccgtaccgaccgtcccgtcccgtacggttaacctacgtttaccgttacggaaccttcccgtaacgtcccgtagggtacggtagtacggtacggttcttagtaacgttttaacgtcgtttacgtacgtaccgtacgaacgttaccgttaacgaacccctaaccgggttcccgggtacggggttccgggttacgggaccggggttaaccgggacccggttaaaccggaaccggttccccggttaaccgtacccggttacccctacggtacccggaaccgtccccggtaaacggtaacccccggg

SEQ ID NO: 174323 - DNA, 756 bp, Homo sapiens
  misc_feature: GYAE6OF01CE4OL.34.39.D06.1.454.CMB.1.raw
  modified_base (213)..(213): a, c, t, g, unknown or other
  misc_feature (213)..(213): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacgagggtcctcgggcccagtctgtcctgacgcacgcccgcctcactcgtccgtccggggccccganagacgtcgtcacctactcctccgtgcctacggtcgggggaccctacctaccaacgtacggtccggggtacgtttacgggtttttggttacgtaacctacgtacgggtaccacggaccgtacgtaccgttaccccggaaaacacccgacccccctaaaccttccctaacttacttacgtttaacgtaaacctaaacgtaacgtcccggtaccctacggtaccggggttccctacgtaaccgtttacgtttccgtaccgtaccctaccgtaacgttccgccggtacctaacccgtcgtaacccgtccccttaccggtacggtaacttacgttacgttacggacctacccgtacgtccgtacggtacggtacgtacgggacgtcgttagttaacttttacgtacttacgtacgtacgtacctaacgtacgtaacgtaaccaaccggttaccggtcggggtaccggttcgggtacgggaccggtacggacgtacgtcgtaccgtcccgtctacgacgtccgacgaccgacgtccgtcccgtaccccg

SEQ ID NO: 174324 - DNA, 946 bp, Homo sapiens
  misc_feature: GYAE6OF01CA4JN.34.39.D06.1.454.CMB.1.raw
tcagtacacgtgatcacgaccggtgctcgatttagtgacatctcgcagttctttgggggcttcagctgtgggcacaagaggcagcactcaggacaatctccagcatcggcctggtctcctctcctcctcactctcctcgctcactcgcacgacgggtcctcgggcccagtctgtcctgacgcacgcccgtccctcacgtcgtcgtccggggcccccggacacggacgacgtaccacctacgtcctccgtcggaccgaccggtcgggggaccctccctaaccgaaccgtacgggttaccgggggttcgttacgggtttttacggttacggttaaccgtaccgttaccggtaccgtacggaccgacggttaacccggttacccggaacctacccggaaccccctaaacctcccgttactacttaccgtttaacgtaaacaaccgtaacgtcccggtcccgttaccgggaccggggttccccgttacggtaccgtttacgtttccgtccgtacccgttaccgtaacgtccgtccgtaaccgtccctaccgtacccgtcccgttacccggtacggtacctttaacggtttaccgttaccgtaaccccgtacccgtaccggtacggttacgggtaaggtgtacgggttaacccggtggttaaacgttttaacgttttaaaccgttcggtttacgtaacccgtaacggttaccgttaaccgaacggttaacccgtaaacccggttaaaccccggtacccggggggttttcgggggtaccccgggggtttaaaccgggtccgggggggtaaaaccggggtaacccgggtaaaaccgcccgggtttaccgttaacccccgggtacggtttaccccccggttaagaccccggggttaaccggaaccccgttaaacccggggcccggttccccggttaccccgttaccccccgggg

SEQ ID NO: 174325 - DNA, 700 bp, Homo sapiens
  misc_feature: GYAE6OF01DN4NH.34.39.D06.1.454.CMB.1.raw
  modified_base (231)..(231): a, c, t, g, unknown or other
  misc_feature (231)..(231): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacgacgggtcctcgggaccctagtctcgtaccgtgaccgccacgcccgccctcacgtcggtccgtccggggacccccganagacgtagtaccacctatcctaccgtcgaccgacggttcggggacctaccctaccaacgtacggtccgggtacttaggttttgtacgtactaccgtcggtaccagtcgtaagtaccgttaccggaactacccgaccccctaatcctactactcgtatcgaacctaaccacctaacgtcccggaccgtacggaccgggtccctgtaaccgttcgttacctcgtacggtcctacgtacgtctcgacctactccgacctccgtccgcgactacgtaccgacgtcgggccgtccgggctagggacggtactaggcgtctagttacttacgtcgtactaccgtacgtttaccttagaaccgtcgaccgtacgtcggttaacgtcggttagttacccggttggtacccgtttaccggtaaccgggtaacgtaccgggtaaacccggtcgttaccccgttccgggttaaacccggg

SEQ ID NO: 174326 - DNA, 875 bp, Homo sapiens
  misc_feature: GYAE6OF01D9S6B.34.39.D06.1.454.CMB.1.raw
  modified_base (230)..(230): a, c, t, g, unknown or other
  misc_feature (230)..(230): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgacacgacgggtccgtcgggccctagtctgtcctgacgcacgcccgccctctacgtcggtaccggtccggggacccccganacggacgacgtaccacctactcctccgtgaccgacggtaccggggacctaacccctaccgaaccgtacggttccggggttacgtttacgggtttttacgttacgttaaccgtaacggttaccggttaaccgaggaccgtaacggtaacccgttaaccccggaaaccaacccgtaacccccctaactacccgttaacgttaaccgtttaacggtttaacggtaaaacctaaccgtaaccgttacccggtaccccggttaccgggtaccggggttacccgttacggttaccgttttacttttaccgtaccgtacccgttacgtaacgttaccggtcggtaccctaacccgtacctacccgtacccccgtaccgttacgtaacgtttaacgtttaacgtaccggtaacccttaccggaacgtaccggtaggaacgggttacggtcggtaacggttacgtttacgttaacttttacgttaaccggttacgttaacgtaccgttacaacgttacgaaccgtaccgtaccggttccggggttaccggggttccgggttacgggttaccgggaaccgggtaaccgggtaaccgtccggtaccgttaccggaccccgttacgaccgtaccgtccgacccggtccgtaacccgg

SEQ ID NO: 174327 - DNA, 718 bp, Homo sapiens
  misc_feature: GYAE6OF01A61UV.34.39.D06.1.454.CMB.1.raw
  modified_base (334)..(334): a, c, t, g, unknown or other
  misc_feature (334)..(334): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacgacgggtcctcgggcccagtctgtcctgacgcacgcccgccctcactcggtcgtcggggcccccgacagagagtccaccatcctcctgcgtacgtcgggggccacctcccaacgacggtcggggtcttagggttttgttcgtaactacgttcggtacctacgcacgtaccgtttacccggaaaccnccgaaccccctaaactccctactacttacgtttacggtaacaacgtactccggtccctccggtacgggtccctaggtaccgttactttccgtcgtccccttaacgacgttccgtacggtacctaccccgtcgaccgtccctacccgttaggaaccttatttacggtccgtaccttacccacgtaccggtagaggtagtcggaacgtaccgtttagtacttttaactttacgtgtaccgtaccgtactaacgtctaaccggaccttaacccggtccgggtttacggggcccgggtttcgtaccgggggtacggaaccggtacgtaaccgcgttaccggtcccgtctacgtacgtccgtaccgacccgtaccggcgtcccgtcccg

SEQ ID NO: 174328 - DNA, 717 bp, Homo sapiens
  misc_feature: GYAE6OF01EXHYL.34.39.D06.1.454.CMB.1.raw
  modified_base (232)..(232): a, c, t, g, unknown or other
  misc_feature (232)..(232): n is a, c, g, or t
tcagtacacgtgatcacgaccggtgctcgatttagtgacatctcgcagttctttgggctctgcttcagctgtgggcacaagaggcagcactcaggacaatctccagcatggcctggtctcctctcctcctcactctcctcgctcactgcacgaggtcctgggcccagtctgtgctgacgcacgccgccctcagtcgtcgtcgggccccgagggcaggacggcaccatctccngcacgtgggacgtcgacgccttaccaacgtagtcggggacgtaggttacgtgtaagttcgtaaccgtacgttacggtaaccgaacggtcctacggtacccgttttaccgaacgggaaaaccctaacccgggtaacccccctaaaacgttccccttaactaacgttacgtaaccgtttcgaaaccgttaaacccgaacccgtaacgtacccgggacccgtacgggtaccgggtacccttacggtaaccgtacgtttcccttaccgtcggtaccgttaccgtaacgtccggtacgtacctaaccgtcgaaccgtcccgtaccctacgggtcctaaccgtccgaacggtcgggacccgttccggacgtaggacgttgtacggagtcgttagtagttaccgtagttcgtacttcgttacccgttacgactcggtaacgcgttacgacggttacgtcgttacttacgttcggtccgtacggtaacccggg

SEQ ID NO: 174329 - DNA, 1009 bp, Homo sapiens
  misc_feature: GYAE6OF01E2T4S.34.39.D06.1.454.CMB.1.raw
  modified_base (835)..(835): a, c, t, g, unknown or other
  misc_feature (835)..(835): n is a, c, g, or t
tcagtacacgtgatcacgaccggtgctcgatttagtgacatctcgcagtttctttggggctctgcttcagctgtgggcacaagaggcagcactcaggacaatctccagcagtggcctggtcctcctcctcctcctcacctctcctcgctcactgaccacgtacgggtccgtcgggccctagttctcgtcctagaccgcaccgcccgtccctccaccgttcggtcccgggtcccgggggaccccccgaagaacggacgacgtcccaacctactcccgttccgtcggaccgtaccgggtccgggggacccaaccctaccgaacgtacgggtccggggttaccgtttagggttttcgttacgtaccgtaccggtaccggtaacccgtaacgtacggtaacgtacccggttaacccccgggaaaccgaaccccgtaacccccctaaaccgtcccttacgttaaccgtttaaccgtttaacccggtaaaacgaaaccgtaaccggtccccggtacccggtaccgggtaacccggggtacccgttcggtaacccgttttcttttacccgtacccgtacccttaacccggtaacggttccggtaccggttacccctaccctacccggtacccgtaccccgttacccggtaacggtaacgttttaacctttaaccgggttaccggtacccgttacccgaaccggttacccgggtaagggtaccgggttaacggtacggtaacggtttcctttaacgtttaaacgttaaccgttttaccggttaccggttaaccgttaacccggttaccttaaacccggtaacgtaacccgggttaaaaccccnccccgggttaaccccggggggttggggggttaccccggggtttaccggggacccggggtaacccggggtaaccgggggaaccccttaacgggtaccccggttacccggttaccccgggttcctaacccggggtacccggtacccgtaaccccgggaaccccggttaccccgggg

SEQ ID NO: 174330 - DNA, 803 bp, Homo sapiens
  misc_feature: GYAE6OF01BRTDT.34.39.D06.1.454.CMB.1.raw
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacgaggtcctgggcccagtctgtcctgacgcacgccgccctcactgtccgtcggggcccccggacagacgacgtcaccattcctcctgcgacgtcgggggacacctaccaacgacggtcggggtcttaggttttgttactacgtacgtacggtaccagcacgtacgtttaccccggaaccgaaccgacccccctaaaccttccctacctacgtttaccgttttacggtaaaaccaaacgtaaccgtccggtacccgttaccggtaaccgggggttccccgtaccggtacccgttacgttttcccgtaccgtaccccgtacctaacggttccgttacgggacctaacccgtccgaaccggtccctacccgttacggtaaaccttagttttaacgtttccggaaccttaccccgaacgttccggtaaggacggtaagttcgggtaacgttaccttaggttaactttttaagtacctttaggttacgtagtaaccttaacgaacgtaccgaaaccgtaaccccggttaccccgggttgggggttacccggggtttaccggaccggggtaccggggaacggttaaccggacggtccgtaccggtcccgtaccgttcgacgttaccgaaccggacccggtaccgcccgtcccggtacccccg

SEQ ID NO: 174331 - DNA, 792 bp, Homo sapiens
  misc_feature: GYAE6OF01BLHZW.34.39.D06.1.454.CMB.1.raw
  modified_base (216)..(216): a, c, t, g, unknown or other
  misc_feature (216)..(216): n is a, c, g, or t
tcagtacacgtgatcacgaccggtgctcgatttagtgacatctcgcagttctttgggggcttcagctgtggcacaagaggcagcactcaggacaatctccagcatggcctggtctcctctcctcctcactctcctcgctcactgcacgtacgggtcctcgggcccagtctcgtcctgacgcgacgcccgccctcactcgtcgtccggggccccganaggagacgtccacctactcctcctcgcgacggtcgggggacctaccctaccaacgtacggtccggggtacgttacgggtttttgttacgttaccgtaccgttacggtaaccgtacgacgtaacggtacccgtttaccccggaaacctacccgaacccccgtaaaccttccgttacctacgttttaccgtttaacggtaaacctaaacgtaaccgtaccggtacccgtaccggtaccgggttacccgtacgtaaccgtttacgtttccgaccgtacccgttacgtaacgtcgtacccggtaccctacccgtaccgaccgttcccttaccggtacgtacttaacgttacgttaccggacttaccgacgtccgtaacggtacggtagtacggtacggtacttacggttaacttttacgttacgttcgtacgtaccgtacaacgtacgtaaccgaaccgtaccggttacccgggtccggggttcgggttacggtcgggaccgggtaaccggtacgtagtacccggaccgtaccgtacgtacgacgttaccgacccggacgaccggtcccgtcccgtcccg

SEQ ID NO: 174332 - DNA, 789 bp, Homo sapiens
  misc_feature: GYAE6OF01ATEFM.34.39.D06.1.454.CMB.1.raw
tcagtacacgtgatcacgaccggtgctcgatttagtgacatctcgcagttctttgggggcttcagctgtggcacaagaggcagcactcagacaatctccagcatggcctggtctcctctcctcctcactctcctcgctcactgcacgagggtcctcgggcccagtctgtcctgacgcagcccgtcctcactcgtctacggggcccccgacagacgagtcaccatcctcctgcacggtggggaccacctcaacacgtcggggcttaggttttgtacgtacacgtacgtaccagcaacgtacgtacccggaacaccgacccctaaactccgtacaacttacgtttacggaaacctaaacgtaacgtccggtaccctacggtaccggggttccctacggtaccgtttaacgttttccgacgtaccccttacgaaacgttccgttacgggacccttacccgtaccgaaccgtccccgttacccgtagggaaccttacgtttacgttacggaaccttcccgaacgccgttaagacggtacgtacgggtaagtcctttaacggtattttaacttacgtacgtactaacggtacctaacgacgtaaccgtaaaccgtaaacccgtcccgggttacgggggtacccggggtttacggttaccgggaaaccgggggtaaaccggaacccggtttaaaacgcccggttacccggttaaaccgtccccgggtttaaactaccggggttaaccccaacggtaaccccgtaacggtaccccggttcccggtaacccccccgg

SEQ ID NO: 174333 - DNA, 739 bp, Homo sapiens
  misc_feature: GYAE6OF01BOZLR.34.39.D06.1.454.CMB.1.raw
tcagtacacgtgatcacgaccggtgctcgatttagtgacatctcgcagtttctttgggggctctgcttcagctgtgggcacaagaggcagcactcaggacaatctccagcatggcctggtctcctctcctcctcactctcctcgctcactcgcacgtacgggtcctcgggccctagtctcgtcctgaccgcgacgcccgccctcacgtcggtccggtccggggacccccgacgaggacgtacgaccacctactcctaccgtcgccgacggtcggggcccaccctaccgtaacgacggtccgggtacgtttaggttttcgttcgtactaccgtacggtacacgacgtacgtaccgttaccggaacctccgaacccctactcctactacttcgttacgaactaacgacgtccgtccgtacggaccggttccgtacgtacgtttctttccgtcgtacccgttacgtacgtcgtaccgaccaccttacgccgtcccgtactacgtacttacgttacgtaccggtcctacgaccgtcgtaggaacgtcgtaggtacgtacgttacgttaactttacgttacgtcgttacgacttaccgtaactactaacggtaccctaccggggtcccgggttacggggtccgggttaccgggttacggggaccgggtacggaaccggtcggtacccgggtacgttaaccccggtcgtacccggaacgtacccgaccgggccccgtaacccggg

SEQ ID NO: 174334 - DNA, 938 bp, Homo sapiens
  misc_feature: GYAE6OF01APKSP.34.39.D06.1.454.CMB.1.raw
  modified_base (193)..(193): a, c, t, g, unknown or other
  misc_feature (193)..(193): n is a, c, g, or t
  modified_base (629)..(629): a, c, t, g, unknown or other
  misc_feature (629)..(629): n is a, c, g, or t
tcagtacacgtgatcacgaccggtgctcgatttagtgacatctcgcagttctttggggctctgcttcagctgtggcacaagaggcagcactcaggacaatctccagcatggcctggtctcctctcctcctcactcctctcgctcactgacacacgggtcctcgggccctgttctcgttcccgagaccggaccnccggcccgccctcgtaccttcggtccggtccgggggaccccccgacgacggaacgacggtacccaccgtacttccgtccgtccgacgtaaccgtccgggggtccaccctaccacgtaacgggtccggggttcgttaggttttacgttcgtaaccgtaccgttacggtaaccccggtagccgtaacgtacccggttaaccccgtaaccggaacccgtacccccgtaaactttaccttaccgtaagtttaccgtttaacggtaaaaccctaaaacggcccggttaccggtaccccgttcgggtaaacccggggtttccctacgtaaccggtttcctttccgttccgggaacccttaccgttaaacggtccgttccgggaaccctttacacccgtaacggtccctaacccgtcggtaactacgtttacgtacgtacccnctacgtcccgtagacggtacgtaccggaggttacccgttagtaaccccgttttaagttacccggtttaacgtacccgtaacgttaacccggtaaccttacggtaacccctaaccggttaacccggtacccggggttttccgggggaaacccggtttacccggggtttaacggggaccccgggggttaaaaccgggacccggttttaaaccgggcccgtttaaaaccccgggttcccgggtttaaccccgtaaaacccggggtttacccctaaacccggtaacccccggtaaccccgggtaaccccgggg

SEQ ID NO: 174335 - DNA, 743 bp, Homo sapiens
  misc_feature: GYAE6OF01EILFJ.34.39.D06.1.454.CMB.1.raw
  modified_base (144)..(144): a, c, t, g, unknown or other
  misc_feature (144)..(144): n is a, c, g, or t
  modified_base (179)..(179): a, c, t, g, unknown or other
  misc_feature (179)..(179): n is a, c, g, or t
  modified_base (238)..(238): a, c, t, g, unknown or other
  misc_feature (238)..(238): n is a, c, g, or t
tcagtacacgtgatcacgaccggtgctcgatttagtgacatctcgcgtaggttctttggggctctgtcttcagctgtgggacacaagaggcagcactcaggacaatcgtccagcatggcctggtctcctctcctctcactctcncgctcactcgcaacgtcgggtccagggcccagttntcgtctagaccgcaacggccgccttagacgttcggtaccggtacccgggggccccaaancggtaacgccggttaccaccgtaacttccggtaccgtggaccgtacggtccggggtacctacccgtaccaacgtaggtccggggtacttcggggttttagtcgtaccgaggttacggtacgaacgtcgtacgtccgttacgaacggtacctaaccggaacccctaaactccttactaccgtaactttaggaccttaaccgaaaccgaccgtaccgtaccgggcccgttcgggaaccgggttcctccggtaacggttaccttccgacgttcggtaccctaacgacgttaccggtccgtaccgtaacctcgcccgttacccgttcctccggctcttaccggaccgtcgggtaacccgtcggacgttggaacgtgtacggtaactcgtaagttactttcttaacgtcggaattcgagtacgtgggttacgacgtacgacccgtagtccggttagcggttactacgtcccgtaaggtcggtacgtacggtaaccggtccggtaaaccgg

SEQ ID NO: 174336 - DNA, 501 bp, Homo sapiens
  misc_feature: GYAE6OF02F2KC5.34.39.D06.1.454.CMB.1.raw
  modified_base (210)..(210): a, c, t, g, unknown or other
  misc_feature (210)..(210): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtctggggcccccganagagagtcaccatctcctgcactggggcacctccaacatcggggcaggtttgtgtacactggtaccagcagattcccggaacagcccccaaatccctcatctttggtaacaacaatcggccctcaggggtccctgaccgatttctgcctccaagtctggcacctcagcctccctggacattattggactccagcctgaggatgagctgattattactgtcagtcacatgacaacacccgtgggcgggtctcggcggaggaccaagctgaccgtcctcagtcagcccaacgg

SEQ ID NO: 174337 - DNA, 730 bp, Homo sapiens
  misc_feature: GYAE6OF02GSF9V.34.39.D06.1.454.CMB.1.raw
  modified_base (417)..(417): a, c, t, g, unknown or other
  misc_feature (417)..(417): n is a, c, g, or t
tcagtacacgtgatcacgaccggtgctcgatttagtgacatctcgcagttctttgggggctctgcttcagctgtgggcacaagaggcagcactcaggacaatctccagcatggcctggtcttcctctcctcctcacttctcctcgctctactgcacagggtcctgggcccagtctgtcctgacgcagccgccctcactgtcctcggggccccccggagacgagagtccaccatctcctgcacgtcgggggccaccctccaacagtccggggctaggtttttcgtagtacacgttggtaccaggccaggtacttccccgggaacgacggacccccaaacgtcctacacttctttacggttaacaaacgtaacttccggaccctacgaacggggttcccctacgacccgttattttccncgtcccttaccgaaggttccgtggtcctaacccgtcaccgtccccttcccgtacggaaccttaacgttttacgttacggaaccttcccgtacgtcccgttaggtaacggtaattcggaacggtaccttaggtaacttttaacgttaccgttacggttacctaacgtccaaccgtacttacggtaaacctaaaccgtccccggttggggtacccggggttctttaccggggccggggtaacgggaaccccaaggttcccgtacggtaccccgttaccgttaccgtacggtaccgtaccggaccccggtaacggg

SEQ ID NO: 174338 - DNA, 528 bp, Homo sapiens
  misc_feature: GYAE6OF02ISPVS.34.39.D06.1.454.CMB.1.raw
  modified_base (235)..(235): a, c, t, g, unknown or other
  misc_feature (235)..(235): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcagattatgatgtgcagttcggtaccaacgagccttaccgaggaacacggacccccaaactcctacatctcaggtgaacaacacgtccggccctcgacggggtccctggccgtattcctcgtgcctccgaacgttcgtcggctccctcacgtccctcccgtcggccctagtcgaggtcgggccttccggtctggaggtatcggacgctagacttattcgtgtcgcagcagtgggatcggacacgctagactcggccttcgtagttcgtactacgg

SEQ ID NO: 174339 - DNA, 546 bp, Homo sapiens
  misc_feature: GYAE6OF02GOXL6.34.39.D06.1.454.CMB.1.raw
  modified_base (514)..(514): a, c, t, g, unknown or other
  misc_feature (514)..(514): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtctggggcccccggacagagagtcaccatctcctgcacgtgggggcacctccaacatcggggctaggtttgttgtacactggtaccagcagattcccggaacacgaccccccaaactccctacatcctttaggtaaacaactaactcggccctcgacggggtccctgaccgtatttctgcctcaagtctgcacctcacgcctcctggactatttatggactccagcctgagatggaggcttgattattactgtcagtcacatcgaacaactacccgtgggccgggtcttcgggcgggaaggaccaaggctacggaccgttccngacgttcaccgcccaaggcctccggtcccccg

SEQ ID NO: 174340 - DNA, 600 bp, Homo sapiens
  misc_feature: GYAE6OF02IXENO.34.39.D06.1.454.CMB.1.raw
  modified_base (367)..(367): a, c, t, g, unknown or other
  misc_feature (367)..(367): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtctggggcccccggacagagagtcaccatctcctgcacgtggggcacctccaacatcggggctaggttttgttgtacactggtaccagcagattcccggaacacgcccccaaactcctacactctttaggtaacaacaatccggccctcgacggggtccctgaccgtattttccgngccctcctaagtctcggccacctcacgtccctcccgtggacctatttattcgggacctcccgagccctagaggtatggagctagtatttaattacgtgtcagtccactagtcgaaccaacgtacccgtggggtccgggttcgttaccgggcgggaacgggacccaaggtccgtcggaaccccgttctaccgacgttaccaccggtccccaagggtcccgtcccggtccccccg

SEQ ID NO: 174341 - DNA, 592 bp, Homo sapiens
  misc_feature: GYAE6OF02H4J29.34.39.D06.1.454.CMB.1.raw
tcagtacacgtgatcacgaccggtgctcgatttagtgacatctcgcagttctttggggggcttcagctgtgggcacaagaggcagcactcaggacaatctccagcatggcctggtctcctctcctcctcactctcctcgctcactgcacagggtcctgggcccagtctgtcctgacgcagcccgccctcactgtctcggggcccccggacagagagtcaccatctcctgcacgtcgggggcacctccaacatcggggctaggttttgttgtacactggtaccagcagacttacccggaacacgacccccaaactcctcatctttaggaacaacaactccggcctcgaggggtccctcgtaccgtatttctcgtcctccgaagtcctggcctacctcacgccctcccgtagactatttacgtcggacctccgacgcctaggaggatggacggtctagtattatactgtcagtaccactatcgaacctaaccgacccggtgggccggggttctcgggaccggtacgggacccaaggtcctcggacccgttccacgtacgtccgaccggtcccgaaggtcccgtcgtccccccgg

SEQ ID NO: 174342 - DNA, 575 bp, Homo sapiens
  misc_feature: GYAE6OF02GLKPF.34.39.D06.1.454.CMB.1.raw
  modified_base (216)..(216): a, c, t, g, unknown or other
  misc_feature (216)..(216): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtccgtcgggggccccccgganagagagtcaccatctcctgcacgtgggggcacctccaacagtcggggctaggttttgttgtacactggtaccagcagacttccggaacacgacccccaaactcctcatctttaggtaacaacaatccggccctcgacggggtccctgaccgtattctctcggctccaagtcgtcggcctacctcacgccctcccgtcggacctactcacgtcgggccgtcccgggcttggaggagtcggaggctgtatttacttacgtgtctagttcctttagactacgcacgtcctgacgtgtcttagtcgttacgttacggaacgtcgggaaccgtaacggtcctacccggttaccgtaggtacccg

SEQ ID NO: 174343 - DNA, 534 bp, Homo sapiens
  misc_feature: GYAE6OF02FUE6G.34.39.D06.1.454.CMB.1.raw
  modified_base (457)..(457): a, c, t, g, unknown or other
  misc_feature (457)..(457): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtctggggcccccggacagagagtcaccatctcctgcacgtgggggcacctccaacatcggggcaggttttgttgtacactggtaccagcagattctcggaacacgcccccaaactcctcatctttaggtaacaacaatcggccctcgacgggtccctgaccgtatttctgcctccaagtctggcacctcacgcctccctggactattagttcggactccagcctgaggatgaggctgatttattactgtcagtcacatgaacaacnccgtgggcgggtcttcggcggacggaccaaggtctacgtacccgtcctcgacgtccgacgacccgaggtcctcccgg

SEQ ID NO: 174344 - DNA, 586 bp, Homo sapiens
  misc_feature: GYAE6OF02G24E4.34.39.D06.1.454.CMB.1.raw
  modified_base (439)..(439): a, c, t, g, unknown or other
  misc_feature (439)..(439): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtcctcgggggccccccggacagagagtcaccatctcctgcacgtgggggcacctccaacatcggggctaggttttgtgtacactggtaccagcagacttcccggaacacgacccccaaactcctcattctttaggtaaccaacaacgtccggccctcgacggggtccctgaccgtacttctcgtcgtctacctaacgtctcggactaccctcacgtcctcccgtgccatccgacgtcgggctccgggntggacgatgacgtctagacttattactcgtctacgttcctttagacgtcgccagtcctaggacgttgtctttagtcgtttccgtacggtaacgtcgggtaaccacggttcctaccggttccgtaaggtccaccggtacccgaaccgg

SEQ ID NO: 174345 - DNA, 398 bp, Homo sapiens
  misc_feature: GYAE6OF02G84I5.34.39.D06.1.454.CMB.1.raw
  modified_base (302)..(302): a, c, t, g, unknown or other
  misc_feature (302)..(302): n is a, c, g, or t
  modified_base (387)..(398): a, c, t, g, unknown or other
  misc_feature (387)..(398): n is a, c, g, or t
tcagtacacgtgatcacgaccggtgctcgatttagtgacatctcgcacctccaacatcggggcaggttttgttgtacactggtaccagcagattcccggaacagcccccaaactcctcatctttggtaacaacaatcggccctcaggggtccctgaccgattttctgcctccaagtctggcacctcagcctccctggacattattggactccagcctgaggatgaggctgattattactgtcagtcacatgacaacaccctgggcggggtcttcggcggagggaccaagctgaccgtcctcngtcagacccaggctcgccccctcggtccactctcgtcccaccctcctcactcacgtgtactgaggcggctggcgaagcgcatagnnnnnnnnnnnn

SEQ ID NO: 174346 - DNA, 691 bp, Homo sapiens
  misc_feature: GYAE6OF02GWUA0.34.39.D06.1.454.CMB.1.raw
  modified_base (214)..(214): a, c, t, g, unknown or other
  misc_feature (214)..(214): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtccgtcgggggcccccganagagagtcaccatctcctgcacgtggggcacctccaacagtcgggctaggtttgtgtacactggtaccagcagacttacccggaacacgacccccaaactcctacactctactgacctaacaccaacgtccgccctcggaccggggtccctcgacccgtacttctccgtacgtcctacccgtaagtccgtcggccctaccctaccgaccgtccccttccccgcggtccctaacgttccgtaaccgttcggggtcccgttacccggggtccgttacgggaacgggtacgtacgggtacgggtaccgttagggttaaaccttttacgtttaaccgttcggttaccgttaaccggtttacccttttaggaaccgtacgtacgtacggtaccgtacggtacggttcgttaccgttagtttccgttacggttaccgggaaccgttcggggtaacccgtacgggtacctacccggttacccgg

SEQ ID NO: 174347 - DNA, 605 bp, Homo sapiens
  misc_feature: GYAE6OF02II6MZ.34.39.D06.1.454.CMB.1.raw
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagcccgccctcactgtcgtcggggcccccgacagagacgtccaccatcctcctgcacgtgggggccacctccaacacgtcggggctaggtttgttgtacacgtggtaccagcagtacgttcccggaacacgacccccaactcctcactcgtttaggtaaacaacaagtccggcctcgacggggtccctcggaccgtatttctcgcctaccaagtcctggccaccgtcacgcccgttccctcggactacttagttcggaccttccgacgcctaggaggtactggaggtcctagtatttacttacgtgtcagtcacgtatacgaaccaaaccgtcccgtaggggtccggggtccttcggggaccgggtacgggaaccgacggaccgtcggtacccgtcctccgtacgtacgaccggacctaaccgg

SEQ ID NO: 174348 - DNA, 655 bp, Homo sapiens
  misc_feature: GYAE6OF02G2H00.34.39.D06.1.454.CMB.1.raw
  modified_base (213)..(213): a, c, t, g, unknown or other
  misc_feature (213)..(213): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggcccccganagagagtcaccatctcctgcacgtgggggcacctccaacatcgggcaggttttgttgtacactggtaccagcagacttccccggaacacgaccccccaaactccctacactctttaggtaaacaacaatccggaccctcgacggggtccctgaccgtattttctcgcctaccaagtctggccacctcacgccctcccgtaggacctagttattcggaaccttccgacgtccctaggacggtactaggacggtcgtagtaatttaacttacgttcgttactaagttacctaacgtacgttacgaaccaaaccgtacccgtgggggtacccggggttcgtttaccggggccggggtaaccggggaacccgtaaaggtcccgttaacggtaccccggttacccgtaccgtaaccggtacccgaccgggtaccccctaaaccgggg

SEQ ID NO: 174349 - DNA, 692 bp, Homo sapiens
  misc_feature: GYAE6OF02G26TR.34.39.D06.1.454.CMB.1.raw
  modified_base (381)..(381): a, c, t, g, unknown or other
  misc_feature (381)..(381): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcacgccgccctcactgtcgtcggggcccccgacagagacgtcaccatctcctgcacgtgggggccacctaccaacacgtcggggctaggttttgtgtacacgtggtaccagcagacttacccggaacaccgacccccaaactcctactacttctttaggtaaacaacaacgtccggacctcgacggggtccctgaccgtatttcncgtcctactaagtctcgtaccaccgtcacgtcccgtcccgtaggaacctagtttacgtacggaccttaccgacgtccgtaggacggtattcgggaacggtcgttaggttaaacttttacgtttacgtaggttacctaacggttacctaacgtagttaccgaaacctaaacccggtacccggttacgggggtaccggggttaccgttaccgggggacgggtaaccgggtaaccgtaacgggtaccgtaccggtaaccccgtcgtacggtacgtaccgaccggacccgtaacggtccgtacccggtaccccgg

SEQ ID NO: 174350 - DNA, 528 bp, Homo sapiens
  misc_feature: GYAE6OF02FLM0I.34.39.D06.1.454.CMB.1.raw
  modified_base (211)..(211): a, c, t, g, unknown or other
  misc_feature (211)..(211): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtctggggcccccganagagagtcaccatcctcctgccacgtgggggcacctccaacatcggggcaggttttgttgtacactggtaccagcagattcccggaacagcccccaaactcctcatctttaggtaacaacaatcggccctcacggggtccctgaccgtatttctgcctccaagtctggcacctcacgccctcccgtggacctattacttggacttccagcctgagatgagctgattattactgtcagtcactatcacaacacccgtgggcgggtcttcgggcggaggaccaaggctacgacccgtccgtacaggtccagcccaacgg

SEQ ID NO: 174351 - DNA, 564 bp, Homo sapiens
  misc_feature: GYAE6OF02G799O.34.39.D06.1.454.CMB.1.raw
  modified_base (212)..(212): a, c, t, g, unknown or other
  misc_feature (212)..(212): n is a, c, g, or t
  modified_base (452)..(452): a, c, t, g, unknown or other
  misc_feature (452)..(452): n is a, c, g, or t
  modified_base (550)..(550): a, c, t, g, unknown or other
  misc_feature (550)..(550): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggcccccganagagacgtccaccatctcctgcacgtgggggcaccgtccaacatcggggctaggttttgttgtacactggtaccagcagacttcccggaacacgccccccaaactccctacacttctttacggtaacaactaactccggccctcgacggggtccctgaccgtatttcgtgccctaccaagttcctggcctacctcacgccctccctggactattacttggacctccacgtccctggaggntacggaggctagtatttagttcgtgtactagtctacatagaccaaccgccgtgggcgggttcgtcgggcggacggaccgagcgtacgaccgttcgacncggcacgcctacgg

SEQ ID NO: 174352 - DNA, 583 bp, Homo sapiens
  misc_feature: GYAE6OF02JATHA.34.39.D06.1.454.CMB.1.raw
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtcgtcggggcccccggacagagagtcaccatctcctgcacgtggggccacctccaacagtccggggctaggttttgtgtacacgtggtaccngcacgacttcccggaacacgccccaaactcctcnttcttacgaacaacaactcgaccctcgaccggggtcctcgtaccgtatttcacgtccctactagtctacggcctacctcacgcctccgtgactatgttcgactctacgctgaggtntcggacgtntntaacttctttactgtactacgtcctacgactcgaacaacgtacccgtcggggtccgggttcgtacgggcgggtacggacgacggtccgcggtaccgtccgtcgacggtcgtaccgaccgacggtccgtccggtcccccg

SEQ ID NO: 174353 - DNA, 708 bp, Homo sapiens
  misc_feature: GYAE6OF02JI3CY.34.39.D06.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
  modified_base (500)..(500): a, c, t, g, unknown or other
  misc_feature (500)..(500): n is a, c, g, or t
  modified_base (534)..(534): a, c, t, g, unknown or other
  misc_feature (534)..(534): n is a, c, g, or t
tcagtacacgtgatcacgaccggtgctcgatttagtgacatctcgcagttctttgggctctgcttcagctgtgggcacaagaggcagcactcaggacaatctccagcatggcctggtcctcctctcctcctcactctcctcgctcactgcacagggtcctcgggccagtctgtcctgacgcagccgccctgactgtcgtacggggcccccgganagagtagtccaccattccnccgtagccgtacgtcgggggcctacctccaaacgcgtcggggcctgggttttacttgtacgaacgtcgtaaccagcacgtagttaccccgggacnccggtaccccccaaactcctacaattccggtaattccggacctaaacaccctaaagtcccggaccgtttccagggggttaccccctggaccctactttcgtccctagggtccctaccgtaacgtccttacgggactccccgttacgaccgtcccctcccgtcggaccttacnccgtaccgtgggccgttacccgggcttaacgggngtaacgttcggaggtaccgttgtaacctttacgttacgtacgtcgtaacctctaacgtacgtacgaaccctacccggtaccgggttccgggggtccgggttcgggttacccggggaccggtaaccgggtacctaacggcccgtaccggtacccggttcccgtaccgacggtacg

SEQ ID NO: 174354 - DNA, 400 bp, Homo sapiens
  misc_feature: GYAE6OF02JAUO4.34.39.D06.1.454.CMB.1.raw
  modified_base (234)..(234): a, c, t, g, unknown or other
  misc_feature (234)..(234): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (383)..(400): a, c, t, g, unknown or other
  misc_feature (383)..(400): n is a, c, g, or t
tcagtacacgtgatcacgaccggtgctcgatttagtgacatctcgcacctccaacatcggggcaggttttgttgtacactggtaccagcagattcccggaacagcccccaaactcctcatctttggtaacaacaatcggccctcaggggtccctgaccgattttctgccctccaagtctggcacctcagccctccctggacattattggactccagcctgaggatgaggctagnttattactgtcagtcacatgaacacacccgtgggcgggtctcggcggaggaccagctgacctctnagtcagccaagctcgcccctgtcactcncgttcccacctcctcactcacgttnactgagcggctggacgaagcganacgtantnnnnnnnnnnnnnnnnnn

SEQ ID NO: 174355 - DNA, 801 bp, Homo sapiens
  misc_feature: GYAE6OF02F9HM0.34.39.D06.1.454.CMB.1.raw
  modified_base (218)..(218): a, c, t, g, unknown or other
  misc_feature (218)..(218): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacagggtcctgggcccagtctgtcctgacgcacgcccgccctcactgtccgtcgggggcccccgganaggacgacgtccaccatcctcctgccacgtggggcacctccaacagtcgggctaggttttgtgtacactggtaccagcagactcccggaactacgaccccctaaacgtccctacacttcgtttacggtaactaacgaactccggtccctacgacggggttcccctaggtacccgtattttcgtcgtcctaccctaacggttccgtacggtaccctacccgtacgtaccggtacccctccccgtcgggtacccctaacgtccgtaacgggtccgggtccgttcccgggtcgttacgggtaacggtacgttcgggtaacgggtccgtttacggaaccgttttaacgtttaaccggtcgggtttacgtaccgaacggttaccgtaacgggttacgggggtaacgtttaacggaacccggtaccggtacccggttaacgggtaaacggtttccgggtaaccccttttaacccggtttacgtttaaccgggtttcccgggtttaaacccggggtaaccgggtttaacccggggtaaaccccggtttaaacccggggttaccccgtaacccccgggtttaaaccccggg

SEQ ID NO: 174356 - DNA, 628 bp, Homo sapiens
  misc_feature: GYAE6OF02I9W9N.34.39.D06.1.454.CMB.1.raw
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagcccgccctcactgtcgtcggggcccccgacagagagtcaccatcctcctgcacgtggggcacctccaacacgtcggggctaggttttgttgtacacgtggtaccagcagtacttacccggaacacgacccccaaactcctacattcttagtaacaacaatccggccctcgacggggtccctgacctacttctcgtcggctaccaagttcctggccacctcgacgccctccgtcggccactcacgtcgggcctccgggcttaggacggtagtcgacgggtcctagtaactttacgttacctaggttcctacgtttccgtttacgacgtacgaccgtaagtccctaggtacggttcgtaacgttttcgttcggttccggtttaacggaaccggttcgggtaacccgtaacgggttccaaccccgggtttaccgttaacgggtacccg

SEQ ID NO: 174357 - DNA, 393 bp, Homo sapiens
  misc_feature: GYAE6OF02GMV39.34.39.D06.1.454.CMB.1.raw
  modified_base (383)..(393): a, c, t, g, unknown or other
  misc_feature (383)..(393): n is a, c, g, or t
tcagtacacgtgatcacgaccggtgctcgatttagtgacatctcgcacctccaacatcggggcaggttttgttgtacactggtaccagcagattcccggaacagcccccaaactcctcatctttggtaacaacaatcggccctcaggggtccctgaccgattttctgcctccaagtctggcacctcagcctccctggacattattggactccagcctgaggatgaggctgattattactgtcagtcacatgacaacaccctgggcggggtcttcggcggagggaccaagctgaccgtcctcagtcagcccaaggctgccccctcggcactctgttcccgccctcctcatcacgtgtactgagcgggctggcaaggcgcatagnnnnnnnnnnn

SEQ ID NO: 174358 - DNA, 637 bp, Homo sapiens
  misc_feature: GYAE6OF02HLYQM.34.39.D06.1.454.CMB.1.raw
  modified_base (211)..(211): a, c, t, g, unknown or other
  misc_feature (211)..(211): n is a, c, g, or t
tcagtacacgtgatcacgaccggtgctcgatttagtgacatctcgcagttctttggggctctgcttcagctgtgggcacaagaggcagcactcaggacaatctccagcatggcctggtctcctctcctcctcactctcctcgctcactgcacagggtcctgggcccagtctgtcctgacgcagccgcctcactgtcgtcggggcccccganagagagtccaccatcctctgcgacgtgggggcacctccaacagtcggggctaggtttgtgtacactggtaaccagcagacgttacccggaacaccgaccccccaaaacgtccctactattcgtttacggtaaacaaccaaatccggccctacgacggggtccctagaccgtatttctcgtcctaccgaagtctcggaccaccttcgacgtcccctccgtacggactaatttacgttcggaaccttccgaagtcccgtaggaacggtactaggaaggtctaggtaatttatttaaccgtgtacctagtccaacagtacgaaccaaccgtacccggtgggtaccggggttcgtttccggggaacgggaccgggtaaccaacgtcgtaaccgtaccgtcccgtagacgtacgacgacccgtaaaccggg

SEQ ID NO: 174359 - DNA, 760 bp, Homo sapiens
  misc_feature: GYAE6OF02G3E3K.34.39.D06.1.454.CMB.1.raw
  modified_base (381)..(381): a, c, t, g, unknown or other
  misc_feature (381)..(381): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacagggtcctgggcccagtctgtcctgacgcagccgccctcactgtcctcggggcccccgtacagagacgtcaccatctcctgcacgtgggggcacctccaacagtcggggctaggttttgttgtacacgtggtaccagcagacgttcccggaacacggacccccaaactccctcacttcgtttaggtaaacaacaacgtccggaccctcgacggggtccctagaccgtatttcncgtcctaccgaagtctggcctaccctcacgtccccttcccgtaggaacctagtttacgttcggacccttcccgaaggtccctagggaacggtacgttacgggaacggtccttaggtaacttttaacgtttaccgtcgttaccgtaacggttacctaaccgtaagttaccggaaaccctaaacccgtacccccgggttagggggtacccgggggtttaccgtttacccggggggacccggggtaaaccgggggtaaccccgtaaacgggtcccggttacccgggtaacccccggtttacccgtaccggtaaccgggttacccgaacccgggtaacccccggtaacgggttccccgttaccccgggttacccccccccggg

SEQ ID NO: 174360 - DNA, 643 bp, Homo sapiens
  misc_feature: GYAE6OF02GJWKB.34.39.D06.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
tcagtacacgtgatcacgaccggtgctcgatttagtgacatctcgcagttctttggggctctgcttcagctgtgggcacaagaggcagcactcaggacaaatctccagcatggcctggtctcctctcctcctcactctcctcgcctcactgcacagggtcctgggcccagtctgtcctgacgcagccgcctcactgtcctggggcccccgganagtagagtcaccatctcctgcacgtgggggcacctccaacntcgggcaggttttgtgtacnctggtacagcagcttccaggacacgccccaaactcctcatctatgctaacaccaatcggcctcaggggtccctgaccgattctctggctccaagtctggcacctcgacgtccctcccgtggcccacgtcctacgtcggggcccttccggggccgttaggacgggtacgtacggacgggtccttacggtaacttttacgttaacgttcggttacctaacggtttcccgttttagaaccgaggtaccaacggttcccgttacgggtaacgttaccgggttactttaacggtttccggttaccggtttaacccgggtaacccggtttacgggggtaaaccccgtaacccgggttaaccccgtaaccccgggg

SEQ ID NO: 174361 - DNA, 707 bp, Homo sapiens
  misc_feature: GYAE6OF02H0C92.34.39.D06.1.454.CMB.1.raw
  modified_base (211)..(211): a, c, t, g, unknown or other
  misc_feature (211)..(211): n is a, c, g, or t
tcagtacacgtgatcacgaccggtgctcgatttagtgacatctcgcagttctttggggggcttcagctgtgggcacaagaggcagcactcaggacaatctccagcatggcctggtctcctctcctcctcactctcctcgctcactgcacagggtcctgggcccagtctgtcctgacgcacgccgccctcactgtcgtcggggcccccgganagagacgtcacatctcctgcacgtcggggccacctccaacagtccggggctaggttttgtcgtacacgtcggtaccagtcagacgttccgaacaccgaccccaaactcctacacttcgtttaggtaaaccaactaacgtccggaccctcggaccggggttaccctcggtaaccgttacttttctacgtacccttaccgtaaacggttcgtcgggtaccctacccgttaccgaaccgtccccttaccccgtaggtaaccctaagttttaccgttccgggtaccttacccgaacggtcccgttagggacggtactacgggaggttaccttagttaaacttttacgttaacgtcgtcgtacgtaccacgtacttacgaaccaaccgtaccggtcggggtcggttccgttccggggacggacgggtacccaacggtccgtcggtaacccgtcgtacgtacggtccgaccgtaacccgacggtccctcccggtacccccgg

SEQ ID NO: 174362 - DNA, 757 bp, Homo sapiens
  misc_feature: GYAE6OF02GOWQA.34.39.D06.1.454.CMB.1.raw
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (630)..(630): a, c, t, g, unknown or other
  misc_feature (630)..(630): n is a, c, g, or t
  modified_base (732)..(732): a, c, t, g, unknown or other
  misc_feature (732)..(732): n is a, c, g, or t
tcagtacacgtgatcacgaccggtgctcgatttagtgacatctcgcagttctttgggggctctgcttcagctgtgggcacaagaggcagcactcaggacaatctccagcatggcctggtctcctctcctcctcactctcctcgctcactgcacgtacgggtcctcgggccctagtcttcgtaccgttgaccgtcgacgcccgccctactactgtccgtccggggccccccgacgagacgacgtccgacctacttcctaccgtgtaccgaccggtcggggaccctacccctaccgaaaccgtaggttccgggggacttagggtttttagttacgtaacctaccgtccggtaaccgagtaccgagtaaccgtttaccccggaaaccgcccgaaccccccgtaaacttcctacctacttacgttacgaaacaacctacgtccgacccgtacgaccggggttccctagtaaccgtttnttttacnccgtacccttaccgaacggttccgacggtccctaaccgtacctacccggttaccctccggtacgtaccttaattacgttaaccggcccttccgacgtacccgttaaggacgttaacgtaggcggtaccttagttacgtttaatttaccngttacctaagtcctacgtagtaacgtaccaaaccgtccgggtacggtcgggttaccgtcgggtaaccggacggtacccgaacgtccgtaccgcccgttaccncgtacgaccgtacggacccgtaccg

SEQ ID NO: 174363 - DNA, 796 bp, Homo sapiens
  misc_feature: GYAE6OF02H0PGD.34.39.D06.1.454.CMB.1.raw
  modified_base (231)..(231): a, c, t, g, unknown or other
  misc_feature (231)..(231): n is a, c, g, or t
  modified_base (311)..(311): a, c, t, g, unknown or other
  misc_feature (311)..(311): n is a, c, g, or t
tcagtacacgtgatcacgaccggtgctcgatttagtgacatctcgcagttctttggggctctgcttcagctgtgggcacaagaggcagcactcaggacaatctccagcatggtctggtctcctctcctctcactctcctcgctcactgcacgagggtcctgggcctagtctagtccgtagacgcacggcccgtcctactacgttcggtccggtccgggggccccccggtanacggtacgtacgtaccgaaccgtattcccgttccgttcggaccgtacggggtcgggggaccctacccgttaccgaaaccncgggttaccggggacgtttacgggtttttacggttacgtaaccgtacggttaccggtaccgacggtacgtaacggttacccggttaccccgggaaacgacccgtaaccccctaacgttcccctacttaacgtttccgtttaacggtaaacctaaccgtacgtacccggtcccttacgggtaccgggttacctaggtacccgtttactttccgtacgtacccgtacgtacgttccgttcggtccaaccgttccgacgtcccgtccgtacggtctactttacgacgttaccgtcgtacgttcggtaaggtaccgtaggtcgacgttacgtagttacttaacggttcgtcgtacgttactacgacgttatacccgtaacgtacccgtacggggtaccgtcgggggttactcgggggaccggttacggaaccgttacggtcgtacccggttacgaccgtaccgtacggacctaccggaccggtaaccgg

SEQ ID NO: 174364 - DNA, 740 bp, Homo sapiens
  misc_feature: GYAE6OF02G58QF.34.39.D06.1.454.CMB.1.raw
  modified_base (125)..(125): a, c, t, g, unknown or other
  misc_feature (125)..(125): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
tcagtacacgtgatcacgaccggtgctcgatttagtgacatctcgcagttctttgggggcttcagctgtgggcacaagaggcagcactcaggacaatctccagcatggcctggctcctctcctcncactctcctcgctcactgcacaggtcctggccagtctgtacctgacgctacgccgcccgtcactgtctcggggcccccganagacgagtccacnctactccncgcacgtggggcacctcaactacgcggggctaacggttttcgtacgtacgacgtcggtaccagcacgtacgttaccggaccaccgcccccaaaacttccacgtactttcgtttacggaaactaaccgaactccggtcccttacggacgggtccctaggtacgttacgtttctcgtccgtacctacgtcgtcgggcctacccggtcaacgtcccttaaccggtacgacgttaatttacggttacgtacccgttacacggtacggtacggtaacggtcgtacggtacggtcttacgttacgttttaaccttacgtcgttacggacgttaccgtaacgcgtaacgtaccctaaccgggttaaccgggtcggggttaaccgggtccgtttaaccggggacgggttaccggtaacccggtaacggttacccggtacgtaaccccggtttacccgtcggaaccgttacccggtaaccggtacccgggtaaacgttccccgggacccgtttaaccccggg

SEQ ID NO: 174365 - DNA, 895 bp, Homo sapiens
  misc_feature: GYAE6OF02IQOG8.34.39.D06.1.454.CMB.1.raw
  modified_base (211)..(211): a, c, t, g, unknown or other
  misc_feature (211)..(211): n is a, c, g, or t
tcagtacacgtgatcacgaccggtgctcgatttagtgacatctcgcagttctttgggggcttcagctgtgggcacaagaggcagcactcaggacaatctccagcatggcctggtctcctctcctcctcactctcctcgctcactgcacacgggtcctgggcccagtctcgtcctgacgcagcccgcctcactgtccggtcgggcccccganagagacgtccaccatcctcctcgccgacggtcgggggccaccctaccaaaccgtcggtccggggtccgttaagggtttttgttacggttaaccgtaccgttcgggtaacccacgcgtaacggtacccgttaccccggaaacaccccggtaacccccctaaacttccctactacgtttaccgtttaacggtaaacctaaactaccgtccccggtacccgtaccgaccggggtaccccttacgtaccgttacttttccgtaccgtcccttaaccgtaacggttccgtcggtaccctaccccgtaccgaccgtaccccttcccggtaacggtaaccttacgtttaacggttcccggaacccttcccgaacgtacccggttaaggacggtaagttcgggaaccggttacttacggtttaacttttacgttaaccggtcgtttacgaaacggttcctaaacgtacgtaacccggaacccgtaacccgggttacccggggggtcgggttacccgggggttaacccggttacgggggggaacccggaaacgggttaacccccgggtacgggtaacccggttacccgggtaacccccgtttaccgggttaacccggaccgttaaccccgggaaacccgttacccccggggtaaaccggtttcccccgggtaccccccggggttcccccccgg

SEQ ID NO: 174366 - DNA, 698 bp, Homo sapiens
  misc_feature: GYAE6OF02JZ4D4.34.39.D06.1.454.CMB.1.raw
  modified_base (274)..(274): a, c, t, g, unknown or other
  misc_feature (274)..(274): n is a, c, g, or t
  modified_base (551)..(551): a, c, t, g, unknown or other
  misc_feature (551)..(551): n is a, c, g, or t
  modified_base (647)..(647): a, c, t, g, unknown or other
  misc_feature (647)..(647): n is a, c, g, or t
tcagtacacgtgatcacgaccggtgctcgatttagtgacatctcgcagttctttggggctctgcttcagctgtgggcacaagaggcagcactcaggacaatctccagcatggctggtctctctctcctcactctctcgctcactgcacgcgggtcctgggccagtctgtgctcgacgcagccgcctcagtcgtcgtcggggacccgagggcacgggacggtccaccgtcttcctccgtacgcgtaccggtgggacgcgaacgtccaccaaacgnggttccgggggctaggtttagtggattacggtacacgttcggaacagtcgtacgtcgttaccgaaggaacccaccgaacccctaactccgtactattcctacgtccgtaacctaaccgaccaaccggtccggccctcggacggtcccgttacgccgtatttcgtcccgtggtacctaccgttaagtcccgtacgaccgtaaccttcggtacccgtaccctacccggtacgtccgttaaccgcggttaccgggtcggggttcccgtacccgggggttnttacgggaaggtaccgagggtaacggttacgtacgtttacgtttaccgtacgtcgttaccgttacgtttccgttaagacccggtagtccacggttnttaggttccgttacttaccgtttaggttccggttaccggttaccggtacgg

SEQ ID NO: 174367 - DNA, 529 bp, Homo sapiens
  misc_feature: GYAE6OF01A3BK7.44.63.F08.1.454.CMB.1.raw
  modified_base (314)..(314): a, c, t, g, unknown or other
  misc_feature (314)..(314): n is a, c, g, or t
  modified_base (415)..(415): a, c, t, g, unknown or other
  misc_feature (415)..(415): n is a, c, g, or t
tcagacagtatatacacgaccggtgctcgatttagcgatcgtataaggggggggtcacaagaggcagcgctctcgggacgtctccaccatggcctgggctctgctgctcctcactctcctcactcaggacacagggtcctgggcccagtctgccctgactcagcctgcctcgtgtctggttctctggacagtcgatcaccatctcctgcactgggtccagcaatgacattgggatatataaccttgtctcctgtatcaacaacatccaggacaaacgcccccaaatcattacttttgatccagtgagcggcgtnaggttgttctaatcgtcttctcgtgtctcagtcgtggcccacgcggtcctcctgtcatctcgtgggcctccggctggacggacgaggctgtactattacgngtcggctctatttacacttctgagtcgttgggtgttcgggcggtacggctcgccgtgaccgttcgagtcgccgccgacggcctcccggtccccgtgtcctccgtccgttccccg

SEQ ID NO: 174368 - DNA, 539 bp, Homo sapiens
  misc_feature: GYAE6OF02FMFVW.44.63.F08.1.454.CMB.1.raw
tcagacagtatatacacgaccggtgctcgatttagcgatcgtataagggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggcaaaccccccaaactcttgattcatgaaatctctaagcggccctctgggatttctgatcgcttctctggctccaggtccggcaacacggcctccctgacaatctctgggctccagccctgacggacgaggctaaattatttctgtttcctctatatacacgttcttgttggtttgggtcttcgggtcgggaggaccgaggtcgaccgtcctaggtcaggcccaaggcctcgccccgtcggtccacttccgtcgttccccgcctcccg

SEQ ID NO: 174369 - DNA, 817 bp, Homo sapiens
  misc_feature: GYAE6OF02FNM7B.44.63.F08.1.454.CMB.1.raw
tcagacagtatatacacgaccggtgctcgatttagcgatcgtataaggggggggtcacaagaggcagcgctctcgggacgtctccaccatggcctgggctctgctgctcctcactctcctcactcaggacacagggtcctgggcccagtctcgccctgactcagcctgcctccgtgtctggttctcctggacagtcgatcaccatctcctgcacgtgggtccagcaatgactagttgggatatataaccttgtctctggtatacaacaacactccgaggaccaaacgaccccctaaactctaagtttacctttttagacgtaccgtagtacggacggtccgggtaccgttcgtacgggttacggttttaccttaaacgttccggttcctttccgttccgttaggtacccttaccgtaacgttccgtacggtcccaaccgtacccggtacccttcccgttcgtccgtacttcccgttcggtacggggcccttacccggggtccctagggaacgggtacggtacggtaccgttcggtaacctttacgtttaccgtaccgggtaccgtactttaaccgttaacttttaaccgtaacccgtttacgttacgggtaacgtttaaccgggtttcgggggttttaccgggttaccggggtcggggtaaccgggttaacccttccgtaccccgggttaccggttaacccggttaccgttaacgggttacccgtaacccgggtaccccggtaaaccggggtccccgttaccgggtacccccccggttagggttacccctaccccggtttccccgtttacccccggg

SEQ ID NO: 174370 - DNA, 266 bp, Homo sapiens
  misc_feature: GYAE6OF01B0CV6.29.10.A10.1.454.CMB.1.raw
  modified_base (258)..(266): a, c, t, g, unknown or other
  misc_feature (258)..(266): n is a, c, g, or t
tcagatagagtactcacgaccggtgctcgatttagcgtcgatctcagggtcttcgtggctcacgtccaccaccacacatgtgacctcaggggtccgggagatcatgagggtgtccttgggtttgggggagaggaagactgacggtcccccaggagttcaggtgctgggcacagcggccctgggctgcctggtaacgaacgtacttacctacgtactacctatactcgtagcgggccgtgcgaacgacggcgatagagnnnnnnnnn

SEQ ID NO: 174371 - DNA, 245 bp, Homo sapiens
  misc_feature: GYAE6OF01CPS03.29.10.A10.1.454.CMB.1.raw
  modified_base (243)..(245): a, c, t, g, unknown or other
  misc_feature (243)..(245): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccagtactctatctgagcgggctggcaaggcgcatagnnn

SEQ ID NO: 174372 - DNA, 246 bp, Homo sapiens
  misc_feature: GYAE6OF01EL0K7.29.10.A10.1.454.CMB.1.raw
  modified_base (244)..(246): a, c, t, g, unknown or other
  misc_feature (244)..(246): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtactctatctgagcgggctggcaaggcgcatagnnn

SEQ ID NO: 174373 - DNA, 244 bp, Homo sapiens
  misc_feature: GYAE6OF01EPB4Z.29.10.A10.1.454.CMB.1.raw
  modified_base (243)..(244): a, c, t, g, unknown or other
  misc_feature (243)..(244): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccagtactctatctgagcgggctggcaaggcgcatagnn

SEQ ID NO: 174374 - DNA, 248 bp, Homo sapiens
  misc_feature: GYAE6OF01CNALJ.29.10.A10.1.454.CMB.1.raw
  modified_base (244)..(248): a, c, t, g, unknown or other
  misc_feature (244)..(248): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtactctatctgagcgggctggcaaggcgcatagnnnnn

SEQ ID NO: 174375 - DNA, 252 bp, Homo sapiens
  misc_feature: GYAE6OF01CV1XP.29.10.A10.1.454.CMB.1.raw
  modified_base (244)..(252): a, c, t, g, unknown or other
  misc_feature (244)..(252): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtactctatctgagcgggctggcaaggcgcatagnnnnnnnnn

SEQ ID NO: 174376 - DNA, 591 bp, Homo sapiens
  misc_feature: GYAE6OF01A2LOW.29.10.A10.1.454.CMB.1.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (272)..(274): a, c, t, g, unknown or other
  misc_feature (272)..(274): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
tcagatagagtactcacgaccggtgctcgatttagcgtcgatctctaggggttccgggagatcatgagggtgtcccttgggtttcgggggaagaggaacgaacgtcgtaccggtcccccctaggagttcaggtgcctaggggcacagcggcccgtcgggcctgccgtaggtcgaaggactacgttccgtacgttacgtcggtctgtagttcgggacgtggccaagggtcgcgaagttaggcangtgntgngagngtgtgcagcnganactcnnnctcnctgtncncgctcgtgtatntacttagtagtagtagntgngcgcgtcncgacgcacgaggaggngtgtgtcgtcgacacacacagagagaagaagtaatatgtcgtactacgtgagacgacgtactactacgtactactacgacgaacgacgaacgaacgaacgtaactactactagtactacgtacaataacgtacaacgacgacgagacgacgaccgacgaacgacgtcgtacgtactacgtacgtacggtacggacgtacgtacgtacgtacgtacgttacgttacgttaccgttacgttacgttcggtcg

SEQ ID NO: 174377 - DNA, 252 bp, Homo sapiens
  misc_feature: GYAE6OF01A08BS.29.10.A10.1.454.CMB.1.raw
  modified_base (243)..(252): a, c, t, g, unknown or other
  misc_feature (243)..(252): n is a, c, g, or t
tcagatagagtactcacgaccggtgctcgatttagcgtcgatctcagggtcttcgtggctcacgtccaccaccacgcatgtgaccgtcaggggtccgggagatcatgagggtgtccttgggttttgggggaagaggaagactgacggtcccccaggagttcaggtgctggcacagcggccctgggctgcctggtcaaggactacttccagtctctatctgagcgggctggcaaggcgcatagnnnnnnnnnn

SEQ ID NO: 174378 - DNA, 250 bp, Homo sapiens
  misc_feature: GYAE6OF01EKEEA.29.10.A10.1.454.CMB.1.raw
  modified_base (243)..(250): a, c, t, g, unknown or other
  misc_feature (243)..(250): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggttttgggggaagaggaagactgaccggtcccccaggagttcaggtgctgggcacagcggccctgggctgcctggtcaaggactactccagtactctatctgagcggctggcaaggcgcatagnnnnnnnn

SEQ ID NO: 174379 - DNA, 247 bp, Homo sapiens
  misc_feature: GYAE6OF02H0GNI.29.10.A10.1.454.CMB.1.raw
  modified_base (244)..(247): a, c, t, g, unknown or other
  misc_feature (244)..(247): n is a, c, g, or t
tcagatagagtactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtactctatctgagcgggctggcaaggcgcatagnnnn

SEQ ID NO: 174380 - DNA, 244 bp, Homo sapiens
  misc_feature: GYAE6OF02HE9N4.29.10.A10.1.454.CMB.1.raw
  modified_base (242)..(244): a, c, t, g, unknown or other
  misc_feature (242)..(244): n is a, c, g, or t
tcagatagagtactcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccagtactctatctgagcggctggcaaggcgcatagnnn

SEQ ID NO: 174381 - DNA, 523 bp, Homo sapiens
  misc_feature: GYAE6OF01C0649.21.19.B08.1.454.CMB.1.raw
  modified_base (501)..(501): a, c, t, g, unknown or other
  misc_feature (501)..(501): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagcctggggggtccctgagactctcctgtgcagcctctggatccgccttcagtacctatagtatgaattggatccgcaggctccaggaagggctggagtggctctcacagattagtggtagtagtagtttcatatattacgcagactcagtgcagggccattcaccatctaccagagacaacgaccaaagtacttccctagtactctgacaaatggacagcctgagagtcgagacacggctatgttatacgtgtggcgggtggcggtggggcgggagtcggacnggcgtggggccgagggtacccg

SEQ ID NO: 174382 - DNA, 723 bp, Homo sapiens
  misc_feature: GYAE6OF01AUYHE.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagcctggggggtccctgagacctctcgtgtcgagcgtcctcgtagtccgtcccgttcctacgtaaccgtaccttaagtaagttagtaagttagtaggtaccgtccgacggacgtcctacggaaagggggaacgggtcggtaggtaggtcggtctcctacgaacgagttagttagggtaggttaaggtaggtttacgttataattaagttaacgttacgacgaacgtactacgtagtcgacggacggacgttactacccgactctccctacgaacggaactaaccgaaccgaacgtaaacgttaaccctttccgtaagttactcgtacaaactaaggtcgaacgtacgtccgtaggacgtacggtacggaacgaccgacggtacttagttagtttaacgttgttacgggcgggttcggggtcggtcgggggtacggggggtacgtagtaccggaacggtacgggtacggggtacccggggaaccgggtaacccgggttaaccccggg

SEQ ID NO: 174383 - DNA, 522 bp, Homo sapiens
  misc_feature: GYAE6OF01CZ1GS.21.19.B08.1.454.CMB.1.raw
  modified_base (424)..(424): a, c, t, g, unknown or other
  misc_feature (424)..(424): n is a, c, g, or t
  modified_base (494)..(494): a, c, t, g, unknown or other
  misc_feature (494)..(494): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgatcaagccgtggggggtccctgagactctcctgtgcagcctctggatccgccttcagtacctatagtatgaattggatccgcagctccaggaagggctggagtggctctcacagattagtggtagtagtgtttcatatattacgcagactcagtgcgagggccattccacctatcctccagagaccaacgacaaagacttccctgtatcngacaagtgacagcctgagagtcgagacacgctatgtatactggtagcgggtggcggtgggggacgggtanggacaggcgtcggggccagggtaacccg

SEQ ID NO: 174384 - DNA, 517 bp, Homo sapiens
  misc_feature: GYAE6OF01BLBEJ.21.19.B08.1.454.CMB.1.raw
  modified_base (457)..(457): a, c, t, g, unknown or other
  misc_feature (457)..(457): n is a, c, g, or t
  modified_base (495)..(495): a, c, t, g, unknown or other
  misc_feature (495)..(495): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaggggctggagtggctctcacagattagtggtagtagtagtttcatatattacgcagactcagtgcagggccattcaccatctccagagacaacgccaagaacttccctagtatctgacaaatggaacagcctgagagtcgaggacacggntatgtattactgtgcgggtggcgtggggcgggatgagnggcgtggggcagggacctcggg

SEQ ID NO: 174385 - DNA, 528 bp, Homo sapiens
  misc_feature: GYAE6OF01BRV9X.21.19.B08.1.454.CMB.1.raw
  modified_base (510)..(510): a, c, t, g, unknown or other
  misc_feature (510)..(510): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagccgtggggggtccctgagactctcctgtgcagcctctggatccgccttcagtacctatagtatgaattggatccgccaggctccgagggaaggggctgggagtggctctcacagattagtggtagtagtagtttcatatattacgcagactcagtgcagggcctattcaccatctccagagacaacgccaagacttccctgtatctgacaatgacacgctagagagtcgaggacacggctagtgtacttacgtggtggcgggtggcggtggggacgggagtcgacgtacgnggtcgggcgcgggtaccg

SEQ ID NO: 174386 - DNA, 549 bp, Homo sapiens
  misc_feature: GYAE6OF01DS9O8.21.19.B08.1.454.CMB.1.raw
  modified_base (525)..(525): a, c, t, g, unknown or other
  misc_feature (525)..(525): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagccgtgggggtccctgagactctcctgtgcagcctctggatccgcattcagtacctatagtatgaattggatccgcaggctccgagggaaaggggctgggagtggctctcacagattagtggtagtagttagtttcattatattacgcagtactcagtgacgagggcctagttcacctatcctccgaagaacgaaccaaccgaccaaagtaacctttccctagtaactctagacaaagtggaccagcctagagacgtgagacacggctaatgtatcgtgtggcgggtggcgtgggggcggatcggacnggacgcggggcccaggggtacccg

SEQ ID NO: 174387 - DNA, 610 bp, Homo sapiens
  misc_feature: GYAE6OF01EQL2D.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatccgccttcagtacctatagtatgaattggatccgcaggctccgagggaagggctggagtggctctcacagtattagtggtagtagtagtttcatatattacgcagactcagtcgcgagggcctattcactatcctaccagacaacaacgaccaaagtacttccctagtactcgtagactaaatcggaacagcctaggacgacggtaccggaaggtaccacgggtacctagttacggttaacttacgtggtacgggtcgggggttcggacgggtcgggggggccgggtaagtacggaacggtacgggccgggttacggggggacccgtaaccgggggtacccgttacgggg

SEQ ID NO: 174388 - DNA, 608 bp, Homo sapiens
  misc_feature: GYAE6OF01D5E0W.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctcgtggactccgccttcacgttacctatagtatgaattggactccgccaggctaccgaagggaaaggggctgggagtggctctcacagtattagtggtagtagtagtttcattatattacgcagtactcgagtcgacgagggcccgtattccactatcctaccgaagacgaacaaccgaccaaagtaacttccctgtaactctagactaagtcggaacagcctaggagagtacggagaccgacggtcttacgtgttaacgttagtggtgggcggggtcgggtcgggtggggggacgggtagtacggacggtacgggacggttcgggggacccgtaacggggtaccccgtacggg

SEQ ID NO: 174389 - DNA, 536 bp, Homo sapiens
  misc_feature: GYAE6OF01AFO1M.21.19.B08.1.454.CMB.1.raw
  modified_base (511)..(511): a, c, t, g, unknown or other
  misc_feature (511)..(511): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgccaggctccgaggaaaggggctggagtggctctcacagattagtggtagtagttagtttcatatattacgcagactcagtgcaggccgattccaccatcctccagacgacaacgccaagtacttccctgtatctgacaagtggacagcctagagagtcgaggaccacggctagtgtattacgtggtcggcgggtggcggtgggggcgggatggacgnggcgtaggggccaggggccctcggg

SEQ ID NO: 174390 - DNA, 636 bp, Homo sapiens
  misc_feature: GYAE6OF01CWQ27.21.19.B08.1.454.CMB.1.raw
  modified_base (323)..(323): a, c, t, g, unknown or other
  misc_feature (323)..(323): n is a, c, g, or t
tcagtcgtcgctcgcacgaccggtgctcgatttagtgagtcagtaagggggagagaggagccttagccctggattccaaggcctatccacttggtgatcagcactgagcaccgagattcaccatggaactggggctccgctgggttttcctagttactattttagaaggtgtccagtgtgaggtgcatctggtggagtcgtgggggagcctggtcaaggccgtggggggtccctgagactctcctgtgcagtcctcgtggactccgccttacacgtacctatagtatgaattggatccgcaggctccgaggaagggctggagnggctctacgacagtattaggtggtagtaagttgttacaattaatacgttaacgctaagaccttagagtgacgaacgggccgtattccgaacctatcctaccgaagacgaaccgaaaccggaccaaaaggtaacctttcccgagtttactaccgttagaactaaaagtcggacaaccgtacccgttaggaacgtacggtacggtaacggaaccgacggtaccttagttacgttattacgcgggtagccggggtggccggtggggacgggtacgtgtaaccggaggtccggagggccgaacgggtccgtaccggg

SEQ ID NO: 174391 - DNA, 576 bp, Homo sapiens
  misc_feature: GYAE6OF01BO335.21.19.B08.1.454.CMB.1.raw
  modified_base (256)..(256): a, c, t, g, unknown or other
  misc_feature (256)..(256): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgatcaagccgtggggggtccctgagactctcctgtgcagcctntggactccgccttcagtacctatagtatgaagttggactccgccaggcctcgaaggaaggggctggagtggctctcacagtatagtggtagtagtagtttcatatacgtacgcaagctcagtgacgagggtccattcacctatcctccagacgaccaacgccaaagtactccctagtactcgtacgacaaagtcggaacagcccgtagacgtagtcggaagaccgacggtctaagttgtattacgtggtacggtcgggtggcgggtgggggaccggtagcggtaacgacggccggtaggggcccgtaagggtaaccccgg

SEQ ID NO: 174392 - DNA, 568 bp, Homo sapiens
  misc_feature: GYAE6OF01ELPZ7.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgcaggctcgaggaagggctggagtggctctcacagattagtggtagtagtagtttcatatattacgcagactcagtcgcgagggccgtattccacctatcctaccagacgaaccaacgaccaagaacttcccctagtactcgtagacaagtggaacagcctaggacgagtcggaaggacacgggctagtgtaattacgtggtggtcggggtggtcggtaggggggcgggatggaacgtgggcggtacgggggccctaacgggggaccctcggg

SEQ ID NO: 174393 - DNA, 720 bp, Homo sapiens
  misc_feature: GYAE6OF01EZA2H.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtgggggtccctgagctcctctgtgcagcctcgtggactccgccttcagttacctagtagtatgaattggactccgcagcctaccgagggaacgggcgtagggagtcggctcgtacacgtaggtattaggttcgggtaagttaggttacgtttacattaattacgttaccgctaagtactacgtaggtacgacggtaacggtcctaacgttaccacctactccgtaccgtaagaacgaaccgtaaccgaaccgtaacgtaacttaccctagtttaactcgttacgaactaaaacgtcggaaccgtacggacccgtaggtaacggtacggtaccgggtaacggaaccgtaacggtaaccgttattaccggttaacgttttacggtacgggtacgggttaccgggggttcggccgggggtttacggggggacgggtacggtacggacggtacggtaccggggttacggggacccgggtaaccggggtaccccgtaccgggg

SEQ ID NO: 174394 - DNA, 619 bp, Homo sapiens
  misc_feature: GYAE6OF01CGG5T.21.19.B08.1.454.CMB.1.raw
  modified_base (256)..(256): a, c, t, g, unknown or other
  misc_feature (256)..(256): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgatcaagccgtggggggtccctgagactctcctgtgcagcctntggatccgccttcacgtacctatagtatgtaattggactccgccgacggcctaccgaaggggaaagggggcgtggggaggtcggctctcacgagtattaggtggtagtagttatttcattatattacgcagactnagtgcgagggcctattcactntctccagacacaacgccaaagtacttccctagtactctagaactaaacgtcggaacacgcctaggacgaggtccggaaggaaccgacgggtacttagttagttaagttaccgtgggttcgggtcgggggttgggtcgggtgggggggaccggggtagtcgggtaaccgagggtccgggaccgggggaccgaccgggggtaaccccgg

SEQ ID NO: 174395 - DNA, 564 bp, Homo sapiens
  misc_feature: GYAE6OF01C6WTH.21.19.B08.1.454.CMB.1.raw
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (458)..(458): a, c, t, g, unknown or other
  misc_feature (458)..(458): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctcgtggactccgccttcagtacctatagtatgaattggatccgcagctcgaggaagggctggagtggctctcacagattagtggtagtagtagtttcatatattacgcagtactnagtgnagggccattcacatctccaganacaacgcaagtaacttcctgtactctgacaatggaacagcctagagagtcgacgacacggtntagtagtacttagtggtcgacggggtcgggacggttggggggacggggtatacgggacgtaacgggtccggtagggggaccccggagggggtacccccttacgggg

SEQ ID NO: 174396 - DNA, 724 bp, Homo sapiens
  misc_feature: GYAE6OF01EPYHU.21.19.B08.1.454.CMB.1.raw
  modified_base (253)..(253): a, c, t, g, unknown or other
  misc_feature (253)..(253): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactcctcgtgtcgcnctcctcgtgctcccgtcctacgacgtacctatagtagtagtagtggtactcccgacgacggtcctaccggaaagggggaacggggtcggtaggggtaggtcggtccttcctaccaagtagttaagttagggttaggttaggttaagtttacgttaactaattaattacgttacgactaagtacctacgtagtcgacgggtacgggtacctactaccacctactccctaggaacgacaaaccgaacccgaaactaaacgttacccttacccgttagtacttcgaacgtaactaaagggtcgaacgtaccgtcgtaaggaaccggtacgggtacggaaccggaacgaccggttacttaggtagtttaacgttacggtggtacgggggtcgggtcggtccgggggagggggcggtacgtacggaacgcgggtacggggtacccgggaaccggtaacccgggtacccggttccgg

SEQ ID NO: 174397 - DNA, 643 bp, Homo sapiens
  misc_feature: GYAE6OF01BJKMG.21.19.B08.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggaggcctggtcaagtccgtggggggtccctgagactctcctgtgcagcctcgtggactccgccttcagtacctatagtatgattggactccgcagctcgaggaaggctggngtggctctacacagtattggtggtagtagttagtttacattatagttacgcaagactcgaggtcgacgtagggccgtattccgacctatccctaccaaggacgtaaccaacccgacctaaagttacctttacccgtgtacttccgataacgtaatcggacctagctagaggtacgtaccggaggtaccacggttacttagtacgttacttccggttggtacgggttccggggtgggtacggggacggggggttacggggagtacgggtaaccggcgggtacgggtaccggggggaccccgtaagggggtacccccgttaccgggg

SEQ ID NO: 174398 - DNA, 796 bp, Homo sapiens
  misc_feature: GYAE6OF01CW5FL.21.19.B08.1.454.CMB.1.raw
tcagtcgtcgctcgcacgaccggtgctcgatttagtgagtcagtaagggggagagaggagccttagccctggattccaaggcctatccacttggtgatcagcactttgagcaccgaggattcaccatggacgtgggctccgcgttggtttcctagttacttatttagaaggtcgtccagtgtgaggtgctatcgtggtggagtcggtggggaggccgtggtacgaacggtccggtcgggggtcccgtggacgtacctctccgtgtcggcacgtcccgtcgtcggtaccgtccgtcccgttactaaccgtttaaccgtaagtttaacggttaagttacggtaagtttacggtaccgtcccggaccgtacggtccgtaccgggaaacggggaaacggggtcggtaggggtacggtccggtcctaccgtacgaacgtagttagttaggtagggttaagttagtttagttactaagttaattattacgacgtacgtactgagtcgacggacggacgtactccacgtactccgaccgagaacgaaccgaacgaccgtaaagtaccgttctagtactaccgtacgaactaagtggaacctacgtaccgtaggaacgtacggtacggtaacgggaaccgtaccgggtattacggtttagttaaccgttacggtgggttaccgggcgggggtttacggggtaccggggtacggggggggtacgggtacgtaacggaccgggtaacggggttacccgggtaccgggggaacccccggtaaacgggggttaaacccccccggtggg

SEQ ID NO: 174399 - DNA, 897 bp, Homo sapiens
  misc_feature: GYAE6OF01BLAIL.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccagtggaacgtggggctccgcgttgggttttcctagttactattttagaaggtgtcagtgtgaggtgcatcgtggtggtaggtcggtgggggacggccgtgggtacgaacggtccggttggggggttcccctggacgtaccttcctccgttggtcgccgacgtcccgttcgtacgggactcccgttccctttacctaacggttaccttaagttagttaagttaggtaaagtttcggacgttcccgcgaacggtccgtaccggaacgggggaaacggggtcgtgggtacggtcggtccttcgtacgacgtaagtaagtttaggttaggttaaggttacgttaacggttttactaattaacgtttaacgttaaccgactaacgtaccttagtacggtcggaaccggtacgggtacccgtaacgtttaccacccgttagttacccgtaccgtaaacgggaaacgaaccccgtaaaacccggaacccgttaaaacggttaaccctttacccccgtaagtttacccgtaccgacgttaaaccgaaaacggttcgggaaccccgtacgtaacccgttaagggaaacgggttaaccgggtaaccgggaaccgggtacccgtaaacggggttacttaaggtttccggttaaacggtttccgtgggggtaacgggggtcggggttacgggtacggggggtccgggggtaagggtaccgtacgggacccggtagggacccgggggtacccggggaaacccggtccggggtaacccccggttcggg

SEQ ID NO: 174400 - DNA, 780 bp, Homo sapiens
  misc_feature: GYAE6OF01DKRKP.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggagcctggtcaagccggtgggggtccctgacgtactcctccgtgtcgcacgtcctcgtggactccgtccttcgaacgttacctatagtatgtaattggactccgaccaggctaccggaaggggaaagggtcgtgggaggtcggtcctctacaactaagtaacgttaggtagggttagttagttagtttactaattactaacttacgcgtaacgtactctaggtcgaccggtacgggaccctacttaccactacgttccgtaccgaagaaccgaaccgaaaccgtaccgtaaaacgttaaccttccccgttaagttacgttaccgtacgaaacggtaaacgttcggaaccacggtaccgtaaggtaacggtagggttaccgaacgggtaacgtaaccggttacgttacgttacggtttaacgttacgggtacgggttaccggggtcgggggtttacgggccggggggttacggggggtacggggtaaccgttacggggaaccggttaccgggggaccccgggtttaccgggggggaaacccggttcccgggttaaaccccggggttaccccggg

SEQ ID NO: 174401 - DNA, 858 bp, Homo sapiens
  misc_feature: GYAE6OF01ESQCK.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggacggcctggtcaagccgtgggggtccctgacgactctcctgtgcagcctcgtggactccgccttacacgttacctatacgtatgtaagttcggacttcccgacccgaggtccctaccggaaggggaaacggggtccgtagggaggttcgggccttccgtacaacgaagttaacgtttaggttacgggttaaggttagtttacggttttacaatttaagttaacgtttaaccggacgtaacggtaccttacgtaacgggttacggaccgtaacggggggtccccttaacgtttaccccgaaacccgttaccgttacccgttaccccgaaagggtaaccggaaaacccgtaaaaccccggtaacccgtaaaacgttaaacccgttttacccccgttaaggtttaaccgtttaccgtacggtaaacctaaacgggttaacggaacccgtaaccggtaccgtacgggaacggtaacgggttaccggggaaacggaaccgggtaccgtacgtttaacgttacggttaacgttttaaccgttgggtacggggttacgggggttcgggtaccggggtcgggggggacgggtacggtacgggaaccggtacgggtcgggtacgggggacccggtaaaccggggtaccccgttaccgggg

SEQ ID NO: 174402 - DNA, 760 bp, Homo sapiens
  misc_feature: GYAE6OF01AZ3VR.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccggaggattcaccatggaacgtgggggctcccgtcgttcgggttttcctagtttacttattttagaaggtgtccagtgtgaggtgcatcgtgggtggtagtcggtgggggagtcccgtggtacgaacggcccggtcggggggtaccctggacgtacctctccgtgtcgcacgtcctgtcggactccgtcttacgagtacctagtagtatagaagttcggactacccggctacggcctaccggaaggggtaacgggtccgttggacggttcggtacctcgtaccgactaaggttacgttaggtagggttagttaggttacgtttacaagttaaattagtaccgacgtaacgtacgtacaaggtagccgacgggtaacctcgttacccgacctcgtacgtaccgaagtaaccggaccaaccgtaacggaactttaccgtaccccttaggtaccttacgaaccgtaacgtaacgaaccggactacggtcccgttaagaacggcggtaacggaacggaaccgttacgggtatacgtttagttaccgtaggttcgggtccggggacggggtccgtagggggtacgggtcgggaagtttaccggaggttaccgggacggggtaccggggaaacccgtcgggtaaccccggtccgg

SEQ ID NO: 174403 - DNA, 682 bp, Homo sapiens
  misc_feature: GYAE6OF01ADDNU.21.19.B08.1.454.CMB.1.raw
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
  modified_base (543)..(543): a, c, t, g, unknown or other
  misc_feature (543)..(543): n is a, c, g, or t
  modified_base (560)..(560): a, c, t, g, unknown or other
  misc_feature (560)..(560): n is a, c, g, or t
  modified_base (583)..(583): a, c, t, g, unknown or other
  misc_feature (583)..(583): n is a, c, g, or t
tcagtcgtcgctcgcacgaccggtgctcgatttagtgagtcagtaagggggagagaggagtccttagccctggattccaaggcctatccacttggtgatcagcactgagcaccgaggattcaccataggactggggctccgcgttgggttttcctagttactatttagaaggtgtcagtgtgagtgcatcgtggtgagtcgtgggggacgtccgtggtcgaacgtccggtcggggggtccctgacgtctcgtccngtcgcgacnccgtcgtggctaaaccgctaattcgaacttacctataagtatgtaattggacctccgcgtaacggcctaccggaaaggggaacggtctagggagtgtccgtacacagaagtagttagggtagtaacggtatacggttanaacgttaataaccgttaacggcaaaggttccngtacgtgaacggtacgggtacctacttaccgaacctatccacgtaaggacaaactaaccgaacgtaacgtaacctcccgtatacgtcctaagactaaagtcactacgngttaacggataccggtnaacggtacacggttatacgtttnagttcgtacggacggggtcggtcgggtagggtccggggtacgggtagttaacggaacgtacggtccggggtaacggtaacccgggccgggttaccccgg

SEQ ID NO: 174404 - DNA, 845 bp, Homo sapiens
  misc_feature: GYAE6OF01BQTKU.21.19.B08.1.454.CMB.1.raw
  modified_base (126)..(126): a, c, t, g, unknown or other
  misc_feature (126)..(126): n is a, c, g, or t
tcagtcgtcgctcgcacgaccggtgctcgatttagtgagtcagtaaagggaaagggggctttcagagagtcatggacctcctgtgcaagaacatgaggcacctgtggttttcctctgctggtggcngctccagatggtcctgtcccagtccacctgcgaggacgtcgggccaggtacgtggtgaacgcccgtcggacgaccctcgtccctctattcgactacgtgtcgttcgtggtacctccgtaccgtcacagtacttcggttccgttcggtacggggtcgtccggggtccggcgaccggttcccaagggtacggaacgggttctaggggaagtcggtaggttgggtagtcgttacgtaagttaacggtacggggtacgttacaaagttagtcgggtacggtacgaacccgttaccttaccccgtaacgtaaccgttaacccgtttacggtttaacgacggttaccgtagtacttaaatacgttacgtacgtaacgttccggccttaccgtacccggttaccaacccggtaaacccgtacgggttaccccttcccggtaaggtacgggtaacttaggaaacgttcgttaccgtacgggtaccggtacccggccggtaaaccgtacgggaaccgtaccgtaacgttaagtttaccgtttcgtaaggacccggaggtaaccgttaacccgggacccggttaagttaccggaccggtacccggtacggtaccggggagttcccggtaacgtttaaccgggtaccgtttcgggaacgttcccggggaacccgggtttccggggtaccccgggttcgggtacccccggtttcccgggttcgtacccggg

SEQ ID NO: 174405 - DNA, 914 bp, Homo sapiens
  misc_feature: GYAE6OF01E3VWJ.21.19.B08.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagtcgtcgctcgcacgaccggtgctcgatttagtgagtcagtaaagggaaagggggctttcagagagtcatggacctcctgtgcaagaacatgaggcacctgtggtttttcctcctgctggtggcagcctccagagtcgggtcctcgtcccaggtccacctgcgaggacgtcgggcccaggactggtagaacgccctggacgtaccctcgtccctntattcgctatcggtntcgtggactcccgtaccggtacactaggtactttcggtttcccgttgggtcggggtccggttccggggttcccggacgtaacccggtccccgtaagggtaacggtaacggggttccgtaggggtagggtacggtaggttcgggggagtttcggttacgttaaaggttaaaggttacgggggggtaacttacggtaaactttagggttccggtacgggtaccggtaacctaccccgttaacccctaaaccgtaacccgttaaaccccggtttacttttaaacggacggttacgaacggttacctaactaacgttaactcgtaacgggtcgaccgtacttcccggtaaccctaacccgggaaccgtaccgtcccttacccggtagtacgggttaacacggttaaacgtacgttccgttagggtacccgggacccgggtactacccggaacggttacccgaaccggtaccgttaagtttccgttcgtaccgggagtacccgggaaaccggccccgggtaaacgggttacgtaccggggtaccgacccggtaccgggtagggaccgggttaaccggttaggttcccgggttaaccggttcgaccgggttacccgggtttcccgggggggacggttccccggggttaccgggggcccccgggtttccccgtggggttaacccccgg

SEQ ID NO: 174406 - DNA, 824 bp, Homo sapiens
  misc_feature: GYAE6OF01CPYSY.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggaggcctggtcaagccgtgggggtccctgagactctcctgtgcagcctcgtggactccgccttcagtacctatagtatgaattggactccgccgaggcctacccgaaggggaaacggggcgtagggaggtcgggtcctccgtacgacgaacggttagtttaagggtgggttaaggttaggtttaacgtttttacgtaaacgtttaaagtttaaaccgtttaaccggtaccgtaaacggtaaacccgttacgtaaacgggtttacgggacccgggtaaaccggggggtccccggttaaaccgttttacccgaaccccgttaactttacccgtaccccgtaacgggaaaccgtaaaccccgaaaaaccccggtccccgtaaaaacgttaacctttccccccggttagttaaccgttaccgttacggaactaaacggttacgggaacccacgggtacccgttaggaacgggtacggtacgggaacggtaccgacggttactaggttagttacttacggtggtcgggtacggggtcgggtcggggtacggggggtaccgggtcgtacgggaaccggtcggtacggggtacggggaccccggtaacggggtaccccgttcgggg

SEQ ID NO: 174407 - DNA, 759 bp, Homo sapiens
  misc_feature: GYAE6OF01A3SI0.21.19.B08.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagtgagtcagtaaggggagagaggagccttagccctggattccaaggcctatccacttggtgatcagcactgagcaccgagtattcaccatggaactgggctccgctgggtttcctagttactatttagaagtgtccagtgtgagtgcatcgtggtggagtcgtggggaggccgtggtanaaggcccgttggggggtccctgggaacgtaccttccttccgtaggtcgacgtacgcccgttccgttagggacgttccccgtcctttaccacgttaaccctagttacgtaattaggaaagtttcgggtaacttcccccggacgtaacggaccgttaccccggaaggggtaaaacggggtccgtagggacggtcgacgtccgtacaaccgtaagttaagttaggttagggtaggttattacggtttaactaagttaattaacgtaccgtacgaactacggtacacggtcgccggaacggtccctaaggttcctaactctaccgttacgacgtacgaaccgtaacgacctaaagtaaccttaccgttacgttatccttagactaacgcggaactccgacctaaggacgtacggtaaccggaggtaaccggtacgtacgtagtacgttaacgttacgtggtacggttcggggtccggtagggtcggggacggggtaccgtagggtaccgtcggtacggtaccgggtcggaacccgggtaccgtacccggg

SEQ ID NO: 174408 - DNA, 986 bp, Homo sapiens
  misc_feature: GYAE6OF01E3VWC.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaacgtggggctccgcgttgggttttcctagttacttagtttagaaggtgtcagtgtgaggtgcagtcgtggtggagtcggtgggggagtcctagactacgaggtcccggtggggggttccctggtacgtaccttccgttccgttcggtacgccgtacgtcccgttcgtcgggtacctcccggtacccctttacgtaaccgtttaccgttaagttaacggttagttaaggtacgttacgggtacccgtaccggacccggtacgggccctaacgggaacgggggtaaacgggggtcgtaggggtacggtcgttccgttacctccgtaacggtaggtttagtttagggtagggttttaaggttacggtttaacgtttactaaacgtttacttaaaccgttaccgacggtaactaccggttacgaacgggtacgtacgggaaccgggtaccttaaccttaccgtaacccgttaccttacccggttaaccgaaaccgggtaaaccgtaaaccccgtaaacccggtaaaccggtaaaccgtttaaacccgtttcccgttaacgggttaccctttacccggaacgttaacccgtaaacggtaccggtaaccctaccggtaaccgttaggggaaaccggttacgggtaccggggtaaccggtaaaccgggtaaccgggttactttaacggttacggtttaaacccggttggggttaacccgggttacggggggttacccgggggtagggttcccgggggggttacgggggtaaccggggttacccgggtaaccggggtaacggttacgggggtaccccggggttaaccgggggtaaccccgggtaacccccgggggttaaccccggg

SEQ ID NO: 174409 - DNA, 660 bp, Homo sapiens
  misc_feature: GYAE6OF01BDEKR.21.19.B08.1.454.CMB.1.raw
  modified_base (200)..(200): a, c, t, g, unknown or other
  misc_feature (200)..(200): n is a, c, g, or t
  modified_base (531)..(531): a, c, t, g, unknown or other
  misc_feature (531)..(531): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaacgtggggctccgcgttgggttttcctagttactattttagaaggtgtccagtgtgaggtgcatctggtggngtcgtgggggagcctggtcaagccgtgggggtcctgagactctcctgtcgcacgtcctcgtggactccgtccttacacgtacctatagtatagtaattcggactccgcgacggtctaccggtaagggaacgggtcgtagggtacgtcggtctcctacacgtagtagttaggtggtaacgttagttagttacaattaattataccgactaagtactacgtagtcgacgtaccggacctaacttccacctacttcctaccgacgtaacgaacccaaccgtaacgaacgtaaccttacccgtgtacttacgtagtacaagtcgaacacgtacgngaagacgtacggagaccgacgtatagtacttagtacggtggtcgggtaccggggtgggtacgggtgggggtacggtagtaccggacgtcgggaccgggtacgggacccggtacgggtacccgtacgggg

SEQ ID NO: 174410 - DNA, 718 bp, Homo sapiens
  misc_feature: GYAE6OF02FPOJU.21.19.B08.1.454.CMB.1.raw
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (557)..(557): a, c, t, g, unknown or other
  misc_feature (557)..(557): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagacctctcgtgcncgcgtcctgngcnccgtcctnactactatatatatagtgactccgacgacgtcctacggaaggggaacggtcggtaggtaggtcggtccttccgtaccaacgaagttaagtttagggttagggttaaggttaaggtttacgttactaattaatttaacgtaccgacgaacgtacctacgtaggtcgacggaccgggaccgttacgtacccaactacttcccaccgaaggaaccgtaaaccgaacccgaaaccgaaaagttaaccccttcccgtaagttaccttcgtacgaaacttaaagggtacgaaccnccgtaccgtaggaacggtacgggtacggaacggaaccgacggtaacttagttaagtttaacttacgttggtcggggtcggggtcggtcgggggtcggggggacggtagtacggacggtacggtccggggtaccgggaccggtaacccgggtacccgttcgg

SEQ ID NO: 174411 - DNA, 521 bp, Homo sapiens
  misc_feature: GYAE6OF02GPM81.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagcctggggggtccctgagactctcctgtgcagcctctggatccgccttcagtacctatagtatgaattggatccgcaggctccaggaaaggggctggagtggctctcacagattagtggtagtagtagtttcatatattacgcagactcagtgcagggccgattcaccatctccagacgacaacgccaaagaacttccctagtatctgacaaatggacagcctagagagtcgaggacacggctagtgtattactgtggcgggtgcgtggggcgggatggacaggcgtggggccagggtacccg

SEQ ID NO: 174412 - DNA, 495 bp, Homo sapiens
  misc_feature: GYAE6OF02FWF5X.21.19.B08.1.454.CMB.1.raw
  modified_base (490)..(495): a, c, t, g, unknown or other
  misc_feature (490)..(495): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccattcaccatctccagagacaacgccaagaattccctgtatctgacaaatgacagcctgagagtcgaggacacggctatgtattactgagcgggctggcaaggcgacatagnnnnnn

SEQ ID NO: 174413 - DNA, 524 bp, Homo sapiens
  misc_feature: GYAE6OF02F7PBW.21.19.B08.1.454.CMB.1.raw
  modified_base (435)..(435): a, c, t, g, unknown or other
  misc_feature (435)..(435): n is a, c, g, or t
  modified_base (499)..(499): a, c, t, g, unknown or other
  misc_feature (499)..(499): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccattcaccatctccagagacaacgccaagaacttccctagtatctgacaaatggacngcctgagagtcgagacgacgctatgtattactgtggtcgggtgcggtggggcgggtatggacgnggcgtcggggaccaggggtaacccg

SEQ ID NO: 174414 - DNA, 604 bp, Homo sapiens
  misc_feature: GYAE6OF02GUM99.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtacctatagtatgaattggatccgccaggctccgaggaaggggctggagtggctctcacagattagtggtagtagtagtttcatatattacgcagactcagtgcgagggccgattccaccatcctccaagacgaaccaaacgccaaaggaactttcccagttactctagacaaagtcggacacgccctaggaaggtacgtccggaagggaccgaccgggtacttaagtagttaacttaccgttgggtcgggcggggttggggccggtaggggggggtccggggtagtggaccggaggtccggtcgggggacccggtaaggggtaaccccgttcggg

SEQ ID NO: 174415 - DNA, 563 bp, Homo sapiens
  misc_feature: GYAE6OF02HWUJE.21.19.B08.1.454.CMB.1.raw
  modified_base (535)..(535): a, c, t, g, unknown or other
  misc_feature (535)..(535): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggggaggcctggtcaagccgtgggggtccctgagactctcctgtgcagcctctggatccgccttcagtacctatagtatgaattggactccgccaggctccgaaggaaaggggctgggagtggctctcacagattagtggtagtagtagtttcatatattacgcagactcgagtgcagggccgattacacctatcctccgagacgaaccaacgaccaaagtaacttcccgtagtacttctagaacaaagtcggacagtcctagagagtcgaaggacgacggtctagtgttattacgtgtcggcgggtggccggtgggggcggtatggacgnggccgtcggggaccacggggaccctggg

SEQ ID NO: 174416 - DNA, 502 bp, Homo sapiens
  misc_feature: GYAE6OF02GDN1V.21.19.B08.1.454.CMB.1.raw
  modified_base (497)..(502): a, c, t, g, unknown or other
  misc_feature (497)..(502): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccattcaccatctccagagacaacgccaaagaacttcccctagtatctgacaaatggacagcctgagagtcgaggacacggctatgtattactgagcgggctggacaaggcgacgatagnnnnnn

SEQ ID NO: 174417 - DNA, 865 bp, Homo sapiens
  misc_feature: GYAE6OF02FX2GX.21.19.B08.1.454.CMB.1.raw
tcagtcgtcgctcgcacgaccggtgctcgatttagtgagtcagtaagggtaaagggggtcgtttcagagacgtcatggacctcctgtgcaagaacatgaggcacctgtggttttcctcctgctggtggcagctccagatcgggcctgtcccaggtccacctgcaggagttcgggcccaggtactcggtagaacgtccctggagacccgtgtccctctatttggctactgtgtctggactccaccgttcacgagtagtcggttcctcgtgggctggggtccggctacgtccccgagtaggtaacgggttcctgggagtaggacgttggggacgttcgttccgtaaggtaaggtacgggggtacgtaccgtaaagttagttcgggtcgggtacgaacctaccgttcccgttaacttaccgtaaccggtttacggttttaaacggacgttacggtacgttccgtaacttatacgttcaaggttcgcgtaccttccggtacccaacggtaaccgtacggttcctacccgttgggaacgtacttacggaacgttacttaccgtacggtacggaccggtacccggtaccgtaacggtacccggaaccgggttaccttaaaagggttttcctttttaacggtacgggtttaccggtaacccgggttaacggtaacccggggttaacccgggtttaaacggtttaccggtaaccccgggtaacccgggttacccgggttacgggggtaaccgggttaccgtaaccgggtttaccggggtttaacccgttacgggtaacgtttaccgggtaccccggtttacggggggttaccccggttacgggtccccgggttcccggttccggggttacccc

SEQ ID NO: 174418 - DNA, 587 bp, Homo sapiens
  misc_feature: GYAE6OF02JPD1N.21.19.B08.1.454.CMB.1.raw
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
tcagtcgtcgctcgcacgaccggtgctcgatttagtgagtcagtaagggggagagaggagccttagcctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagccctctggactccggccttcagtacctatagtatgaattggatccgcaggctaccagggaaggggctggagtggctntcanagattagtggtatagtattcaatnttatcgangactcagtgacgagggaccctattcaccatcctcagagacaaccgaccaagtaacttcccgtagtactcgtanactaaattcggaacncgtccgtagaagacgtacggaaggaacgaaccgggtntaacgtagttaactagttggacgggtcgggtcgggtcgggtagggggacgggacgttaggacggcggccggtacggggaccgtacgggtaccgtcggg

SEQ ID NO: 174419 - DNA, 652 bp, Homo sapiens
  misc_feature: GYAE6OF02HJQO1.21.19.B08.1.454.CMB.1.raw
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
tcagtcgtcgctcgcacgaccggtgctcgatttagtgagtcagtaagggggagagaggagccttagccctggattccaaggcctatccacttggtgatcagcactgagctaccgaggattcaccatggaactggggctccgctgggttttcctagttactattttagaaggtgtccagtgtgaggtgcatctggtggagtcgtgggggaggcctgatcaagccgtgggggtccctgagactctcctgtgcagcctctggactccgccttcagtacctatagtatgaattggactccgcaggctccgaagggaagggctggagtggctcgcacagtattaggtggtaagtagtagtttcattatattacgnagtactcgagtcgngacggctattaccacctatcctacccgaaggacgaacccgaaacgtccgaaaagtaacctttcccgtagttaacctcgttaacgactaaagtcggaaacctcgacgttagaggtaacgtcggaacgggtaccaacgggtacttaagttagttaactttacggtcggttagggccggggttacgggcgggttagggggggacgggtacgttacggaaccggtaccgggtacccgggtacgggggtacccgtaaccggggtaacccccgg

SEQ ID NO: 174420 - DNA, 538 bp, Homo sapiens
  misc_feature: GYAE6OF02HJUCV.21.19.B08.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggactccgccttcagtacctatagtatgaattggatccgcagctccaggaagggctggagtggctctcacagattagtggtagtagtagtttcatatattacgnagactcagtgcagggccagtttcaccatctaccagacgacaacgccaaagtacttccctgtactctgactaaatggacagcctaggagagtcgaggacacggactatgtattcgtgtgcgggtggcggtgggggcgggtatcggacgaggccgtcgggggacctagggaccccgtcggg

SEQ ID NO: 174421 - DNA, 654 bp, Homo sapiens
  misc_feature: GYAE6OF02F8388.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcacgcctctggactccgccttcagtacctatagtatgaattggatccgccaggctccgaggaaggggctgggagtggctctcacagtattagtggtagtaggtagtttcatatattacgcagtactcagtcgcgacgggcgtactccacctatctccagacgaccaacgaccaaagtaacttcccctagttactacgtcgtaacgaaatacgggaccacgtacccgttggaacggtacgtaccggaagggaccacgggtactagttaacgttacgttacgtagggtcgggaccgggggttacgggtccgggtacggggggaaccgggggtacgtttaaccgggaaccgggttcgggtacccggggttagggggaccccgtaaccgggggtaccccgttaccggggg

SEQ ID NO: 174422 - DNA, 572 bp, Homo sapiens
  misc_feature: GYAE6OF02I4NHI.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagcctggggggtccctgagactctcctgtgcagcctctggatccgccttcagtacctatagtatgaattggatccgcaggctccaggaagggctggagtggctctcacagattagtggtagtagtagtttcatatattacgcagactcgagtgcgagggccattcaccatctcagagacaacgccaagaacttccctgtactctgactaaatcggaacacgcctaggacgtagccggaaggaccgaacgggcttaagtcgttaattacgtaggtgggtaccggggtgggacggttggggggaccggggtagtacggacggtaggccggtcgggggacccgacggggtaaccccgg

SEQ ID NO: 174423 - DNA, 653 bp, Homo sapiens
  misc_feature: GYAE6OF02HYI5Q.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgatcaagcctggggtcgtccctgagactctcctgtgcagcctcgtggactcccgccttacacgtacctatagttatagtaagttggactcccgccgaggcctaccggaaggggaaacggggtctagggagtcggctcctcacagtagttaggtaggtagttaagttagtttacaattatacttacgcaagtactacgagtcgacgacggggcctaatttccaacctattcctaccgaagaacgaaccaaccgaccaaagtaacctttccctagtactctgaactaaagtcggacacgtcctaggacgtacggtacggaacggtaaccgacgggtacttagtagtttactttacggtgggtcgggtccgggggttgggccgggttcgggggggacgggtatcgggaaccgagggtccgggtcgggggaccctaacccggggg

SEQ ID NO: 174424 - DNA, 662 bp, Homo sapiens
  misc_feature: GYAE6OF02G2XR9.21.19.B08.1.454.CMB.1.raw
tcagtcgtcgctcgcacgaccggtgctcgatttagtgagtcagtaaggggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactccgccttcagtacctatagtatgaatggatccgccaggctccgagggaaggggctgggaggtggctctcacagattagtggtagtagttagtttcatatattacgcagactcagtgcgacgggcctacttccacctatcctccaaggacgaaccaaccgaccaaacgtaactttcccctagttacttcgtagactaaatacggaacacgtcctaggaacggtacgtaccggaagggtaccgaaccgggtacttaagtacgtttacgtttacgttgggttacgggtccgggggttcggggtaccgggttgggggggggtaccggggggtaagttacgggaacggtaacggggtccgggtacggggggggaccccgtacggggggtaacccccgtccggggg

SEQ ID NO: 174425 - DNA, 619 bp, Homo sapiens
  misc_feature: GYAE6OF02H5EXP.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctggtttcctagttactattttagaaggtgtccagtgtgaggtgcatctggtggagtctgggggaggcctgatcaagcctggggggtccctgagactctcctggtgcacgcctcgtgggatccgccttcagtacctataagtatgaagttggatccgccaggcctacgaacggaaaagggctggacgtggctctcacagtattaggtggtagtaggtagttcgtaatatatacgcagactcgatgacgaggctacgtcaacgactctcaagaagaacgaaaccgacaaacgaacttccgtagtattactcgaacaaagtgaacgactccgtaagagtaacgtcgaacggaacgtaacggtactaagtacgttaagttacgtggttcgggacggggtggtaccggggtacggggggtcgggggtaagtacgggtaacgtacggccgggttacgggggacccggtacggggtaaaccccgg

SEQ ID NO: 174426 - DNA, 600 bp, Homo sapiens
  misc_feature: GYAE6OF02GAI2I.21.19.B08.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatccgccttcagtacctatagtatgaattggatccgcaggctcgaggaagggctggagtggctctcacagtattaggtggtagtagtagtttcattatattacgcagtactcagtgacgagggccgatcaccatcctccagacgacaaccgaccaaagtacttccctagttactcgtagactaaagtcggaacncgacctggaacgtacggtacgaacggtaccgaccgggtcttagtacgttaacgttacgtgggtacggacggggttcggtccgttcggggtacgggacgggtatacggaccggtaggtccggtacggggaccgaaccgggtaaccccgg

SEQ ID NO: 174427 - DNA, 594 bp, Homo sapiens
  misc_feature: GYAE6OF02I8VRH.21.19.B08.1.454.CMB.1.raw
  modified_base (256)..(256): a, c, t, g, unknown or other
  misc_feature (256)..(256): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgatcaagccgtggggggtccctgagactctcctgtgcagcctntggatccgccttcagtacctatagtatgaattggatccgccacggcctccgagggaaggggcgtgggaggtggctctcgacagtattaggtggttagtagttagttactatatattacgcacgtactagagtgcgagggccgtattccacctactcctacaagacgacaacgacctaaagtacttcctagtactntacgacaagtcggacncgcctagaggtaagcggagaccacggtctatagttagttacgtgtacgggcggggttgggacgggtcggggacggggtagtcgggacggtacggtcgggccggggtacccggaacgggtaaccccgg

SEQ ID NO: 174428 - DNA, 849 bp, Homo sapiens
  misc_feature: GYAE6OF02JOJXZ.21.19.B08.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggtttcctagttactatttagaaggtgtccagtgngaggtgcatctggtggagtcgtgggggaggccgtggtcaacggtccgtgggggtccctgagacgtctcctgtgcagcctcgtggactccgtccttcacgtacctatacgttatagaattggacttcccgacgaggacctaccggaagggaaacggggtcgtagggacggtcgggtaccttccgtacgaaccgagtaatttacgggtaggttaaggttaacggttaggttttaactaagttaacgttaagtttaaccgacgtaacgtaacctcgtaaagttcgacggaacggggtcccgtaaacgttcccgaacgtaaccgttcctacccgaaacggaaaccgaacccgaaacccggaaccctaaaacgggttaaaccctttcccgtaaacgggttacttaccgttaagaccctaaaagtcggggtaaacccgtacgggtacccttaaggggtaaaccgtaaccgggtaaccgggtaaccgggtaaacccgacgggttaacccgtacgtttaagggtaaccgttttaaccggttcgggttacgggacccgggggttgggttccgggttaacggggtaccgggggttaacggggggttaacgtacggggttaaccggacccggggtacgggtttacccggggggaaccccggtaccgggggttaacccccggg

SEQ ID NO: 174429 - DNA, 781 bp, Homo sapiens
  misc_feature: GYAE6OF02JMDFH.21.19.B08.1.454.CMB.1.raw
tcagtcgtcgctcgcacgaccggtgctcgatttagtgagtcagtaaggggagagaggagccttagccctggattccaaggcctatccacttggtgatcagcactgagcaccgaggattcaccatggaactgggctccgctggtttcctagttactatttagaagtgtccagtgtgaggtgcatctggtggagtcgtgggggaggcctgatcagccgtgggggtccctggacgactctcctgtgcacgcctcgtggactcccgtccttcacgttacctatagtatagtaagttggactccgccacggcctaccgaagggtaaacggggcgtagggacggtggccttcgtaccaacgtagtaacgtttaggtcggtaagttacggttagtttacaatttaagttaattaccgactaacgtaccttacgtaagttggaccgtacggggtccctaacgttccaacccgtacctaccgtacccgaaggtaacgaacccaaaccggaccctaaagtaaaccctttcccccgttaagtaacgttccgtacgaaccgtaaagtacggaccgtaacgtccgtaaggaacggtacggtacggtaaccggaccgttaccggtaacgttacgttacgtttaaaccgttacgttgggttaacccggggtcggggtttaacgggcccgggggtttaaacggggggggacccggggttaaggttaccgggtaacgggtacccgggttaccgggggtaaccggggttacccccgggtaaccgggggttaaaccccgg

SEQ ID NO: 174430 - DNA, 642 bp, Homo sapiens
  misc_feature: GYAE6OF02FVBGU.21.19.B08.1.454.CMB.1.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (470)..(470): a, c, t, g, unknown or other
  misc_feature (470)..(470): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttccagttactattttagaaggtgtccagtgtgaggtgcatctggtggagtcgtggggaggcctgatcaagcctggggggtccctgagactctcctgtgcagcctntggactccgcttcacgtacctanacgtatagattgatccgcngctaccgaggaagggtcnggagtcggctcncacgagtagttagtggtagtacgtagtttacattatattacgcaaggtactactagtggcgaaggggtcctattaccgaactacgtcctaccggagaacgtaaccaaccgacctaaacggtaacttcccgtagttactacgttanacgtaagtacggactacggacctaggaacggtacgtacggaacggtaaccgaacggtacgtaagtgttaacgttacctgggtacggtcgggggtacggtgggtacggggggtacgggtagttaccggacggtacgggtaccgggtacggggacccgtacggggtaaccccgg

SEQ ID NO: 174431 - DNA, 751 bp, Homo sapiens
  misc_feature: GYAE6OF02IR2NL.21.19.B08.1.454.CMB.1.raw
tcagtcgtcgctcgcacgaccggtgctcgatttagtgagtcagtaagggggagagaggagccttacgccctggattccaaggcctatccacttggtgatcagcactgagcaccgaggattcaccatggaacgtgggctccgctgggttttcctagttactatttagaaggtgtccagtgtgaggtgcatctggtggagtcgtgggggagctgatacaagccgtgggggtccctgacgactctccgtgtcgcacgcctcgtggactccctccttcgaacgtacctaatacgtatgtaaagttggactccgcgacggctaccgagggtaaagggctaggagtcggtctctacgaacgagtagttacggtaggttaagttgtacgtttcaaattacttaacgttacgcgtaacgtactcgtaaggttcgacggtacgggtaccgtacttaccaaccgtacgttccacccgaaggtaccgaaaccgtaaaccggacctaaaaggtaaaccttttccccggtaaggtttaaacccgtcgtttaacggaaacccttaaacggggttacggaacccgtaccgggtttaaccccaaggggtaacccggtaaacggttaccgggaaaccgggtaacgtaacccggtagtttaacgttacgtttaacttaaccgggttggtacggggtcggggtcggtacgggtcgggggtacggtagtacgtacggaccggtacgggtcgggtaccggacggttaacccg

SEQ ID NO: 174432 - DNA, 622 bp, Homo sapiens
  misc_feature: GYAE6OF02HIKMV.21.19.B08.1.454.CMB.1.raw
  modified_base (471)..(471): a, c, t, g, unknown or other
  misc_feature (471)..(471): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctggagactctcctgtcgcacgccctcgtgggactcccgccttcagtacctatagtatgaattggactccgccacggctaccgagggaaagggcgtaggagtggctcgtcacagtatagtggtagtagttagttcatatattacgcagactcgagtgacgacgggccattccaacctatccaccgaagacgaaccaacgaccaaacgtaacttaccctagtaacttcgtagaacaaagnggaaccacgccgtaggagacggtacgaggacgacggtacttagtattaacgttacgtggtcgggtacgggtcgggacgggtgggggacgggtagtacggacgtacgggacgggtaccgggggacccggtaccgggtaacccggttaccggg

SEQ ID NO: 174433 - DNA, 600 bp, Homo sapiens
  misc_feature: GYAE6OF02IFRKE.21.19.B08.1.454.CMB.1.raw
  modified_base (318)..(318): a, c, t, g, unknown or other
  misc_feature (318)..(318): n is a, c, g, or t
  modified_base (598)..(598): a, c, t, g, unknown or other
  misc_feature (598)..(598): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagctctcctgtgcagcctctggactccgccttcagtacctatagtatgaattggatccgcaggcctaccgagggaaacggggngtaggaggttcggctcgacacagtattaggtggttagtagtagtttacattaattattacggcagtactcagtgctagggacctattccaccatcctacccaagacacgaaccgcaaacgtaaccttcctagtatcgtgaactaaagtcgaaccagacctaggaacgtacggtaccggaaggtaccgtaaccggtcctaagttagttaacttacgtaggtaccggtacggggtcttacggggctaaaggggccgaaccgttaagacggtgtagcgtacgnag

SEQ ID NO: 174434 - DNA, 664 bp, Homo sapiens
  misc_feature: GYAE6OF02FTS3Q.21.19.B08.1.454.CMB.1.raw
  modified_base (573)..(573): a, c, t, g, unknown or other
  misc_feature (573)..(573): n is a, c, g, or t
tcagtcgtcgctcgcacgaccggtgctcgatttagtgagtcagtaaggggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggctgatcaagccgtggggggtccctgagactctcctgtgcacgcctcgtggactcccgtccttcagtacctatagtatgaattggactccgccaggcctaccgaagggaaggggctgggagtggctctcacagtagttagtggtagtagttagtttcatatattacgcagtactcgagtcgacggtacggggccctattaccaaccgtatcccgtaccgaaggaacgaacctaaacccggaccctaaaagtaacctttccccgtagttaactcgtagaacctaaaagtcggtaaccacgtacccgtaggaacggtacggtaccgggaacgtaaccgacggtacttaagttcgttaatttccgnggttcggggtcggggtcggtccgggtggggggtaccgggtataccgggaagtccgggaccgggtcgggggacccgtacggggtaaccccgg

SEQ ID NO: 174435 - DNA, 794 bp, Homo sapiens
  misc_feature: GYAE6OF02H03F7.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgcttgggttttcctagttactattttagaaggtgtccagtgtgaggtgcatctggtgagtcgtgggggagcctggtcaaggccggttcgggggtccctggacgacttctccgtgtcgccagtcctcgtacggacttcccggtcctttacgaacgttaaccctaataacgttataggtaagttggaactcccgaccgaggtcctacccggaaaggggtaaacgggggtcgtacgggtaggttcggtccttaccgtaccgaacgtaaggtaagttttaacgggtaggggttaacggttaacggtttacgttttaacaagtttaacgtttaacgttaaccggactaagtaccgtacgtaggtcgacggacgggtacctaactttcccgaactactacccgttacgaacggtaacgaaccaaaccggtaaccctaaagtaaccctttcccgttaagtaacttccgtaacgtaacgtaaacgtcggacctaacggtccgttaggaacggtaccgtaccggaaggtaaccgtacgggttacttaagttacgtttaacgttaccgttagggtcgggttacggggtacgtacgggggtacggggtacgggtagtccggaaggttaccggcggttaccggggaccgtaccgggtaccgtaccgg

SEQ ID NO: 174436 - DNA, 587 bp, Homo sapiens
  misc_feature: GYAE6OF02IBUO5.21.19.B08.1.454.CMB.1.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
tcagtcgtcgctcgcacgaccggtgctcgatttagtgagtcagtaagggggagagagagccttagccctggattccaaggcctatccacttggtgatcagcactgagcaccgaggattcaccatggaactggggctccgctgggttttcctagttactattttagaaggtgtcctagtgtgaggtgcatctggtggagtcgtgggggaggccgtggtcagcgtgggggtccctgagactctcctgtgcngcctntggactccgtccttcacgtacctatagtatgaagttggactccgccgacggctcccgagggaaacgggcgtaggagtggctctcanagattagtgtagtagtattacatatatacgacagtactcgngtgcgacggcatccactntctcgagacacaacgaccaatacttcctagtactctagaactaagtacgacacgaccgttaggaggtacgtacgggagaaccgtacggtactagtgttacttagtggtcgggtcgggtcggtcgggtcgggggccgggtagcggtacgacggtcggtacggggacccgtaccgggtaccgtaccgggg

SEQ ID NO: 174437 - DNA, 756 bp, Homo sapiens
  misc_feature: GYAE6OF02GXNK0.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctgggtggagtcgtgggggaggcctggtcaaggccgtgggggtccctgagactctcctgtgcagcctcgtggatccgccttcagtacctatagtatgtaagttggactccgcaggcctacgaagggaagggctaggagtggctcgcacgtagtagttaggtacggttagttaacggttagtttacaagttaagttaacgttaccgaccgtaaggtaacctttcggaacgttcggaccggtacgggggtacccgtaactttaccgaaccctaacgtttacccgaacccgtaagggaaccgtaaacccaaacccgtacccggtaaaacgtaaacccgttttcccccgttaaggttacttaccgttaacggaaccttaaacggtcgggaaacctacggtcccgtaagggaaaccggtggtaaccggaacggaaccacggttacttagtaagttaacgttacggtcggtacgggtaccggggttcggacgggttcggggggaacgggtagttaccgggaacgtacccgggtggttacccgggggaccggttaaccggggacccgttccggg

SEQ ID NO: 174438 - DNA, 674 bp, Homo sapiens
  misc_feature: GYAE6OF02HE5HN.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgatcaagccgtgggggtccctggacgactctcctgtgcagcctcgtggactcccgtccttcacgtacctatagtatgaagttggatccgacaggcctacgaaggaacgggctaggagtacggctctcacagtattagtggtagtagttagttcatatattacgactacgactacagtagcgacgggctagttaccacctatctacagaacaacacgacaaacgtaacttccctagttactacgtacgaactaaacgtacggaacctacggtcccgtaagggaacgggtacggtacggaacgggtaacctaacgggtacctttaaagtacggtttaacttacgggttcggtaccgggggtcgggggttacgggccgggggttaggggggaccgggggtaagttacgggaacggtacgggtccggggtaccgggggtacccgggtaaccgggttaaccccggg

SEQ ID NO: 174439 - DNA, 803 bp, Homo sapiens
  misc_feature: GYAE6OF02HQEHO.21.19.B08.1.454.CMB.1.raw
  modified_base (264)..(264): a, c, t, g, unknown or other
  misc_feature (264)..(264): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgcttcgggtttcctagttactattttagaaggtgtccagtgtgaggtgcatctggtggagtcgtggggacggccgtgtacgaacgccgtgggggtccctggaacgaccttcgtcctgtacgacgngtccctgtcggactccgtccctttacgacgtacccgttaagtagtagttacgtaagttcggactccgctacggccttacggaggaacgggtcgtggagtcgactctcaacgagtaattggtaggtacgttagttaacgttctaagttatacgttaacgcctaaggactccgtaaggtcgacgtacgggtccaacgtttccgaaccacgtcctaccgaaggacgaaaccgaacgtaaccgtaaacggttaaccttcccgtagttaacccgttacttaccggaaactaaacgggttacgaccgtacggttacccggtaacggtaacgggtccggtaaaccgtaaaccgggtaccgtaccgggttaacccgttaaagttaacccgggttttaacgttttaaccggtggggttaccggtaccggggggttcggttcgggttaccgggttaagggggttacccgggtaaggttacccggtaaccgggtaccgttaacccggggggtacccgggtacccggtaaacccggggttaacccccgggg

SEQ ID NO: 174440 - DNA, 776 bp, Homo sapiens
  misc_feature: GYAE6OF02IN3H9.21.19.B08.1.454.CMB.1.raw
tcagtcgtcgctcgcacgaccggtgctcgatttagtgagtcagtaagggggagagaggagccttagccctggattccaaggcctatccacttggtgatcagcactgagcaccgaggattcaccatcggaactggggctccgctgggttttcctagttactattttagaagtgtccagtgtgaggtgcatctggtgagtcgtggggacgcctgtcaagccgtgggggtcctgatactctcctgtgcacgctctggctccgcttccagtacctatacgtatagaagtttggactccgcgaggtccttaccggaaggggtaaacgggcgtagggtaggtaggcctactccaaccgtaagaacgtttggtacgtaaggttagttagtttacctaagttaactaacgttaccgataacggtactaacgtacgttaggacgtcggggaccctagtttaccgacctagttacccctaaccgtacggaaccgtaaccaaacccgaccctaaaaggtaacctttaccccgtagttacccgttacgtacgtaaacctaaaccggttacggaaccgaaccgttccctaaggtaacggttcggtaaacggcgggaaccgtaaccgggttacttacgttaaggttaacctttccggttaacgggtcgggttaaccgggggtaggttaccggggtacgggggggtaaccgggtacggtttaacggtcggtaaacccggggttcggtacccggggggtaacctacccgggggtacccggtttaacccgggg

SEQ ID NO: 174441 - DNA, 709 bp, Homo sapiens
  misc_feature: GYAE6OF02F8YZI.21.19.B08.1.454.CMB.1.raw
  modified_base (554)..(554): a, c, t, g, unknown or other
  misc_feature (554)..(554): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaacgtggggcctccgcgtgggttttcctagttactattttagaaggtgtccagtgtgaggtgcatctggtggagtcgtgggggaggcctgatacaagccgtcgggggtcctgacgactctcctgtgtacgcctcgtgtactccgtccttacgacgttacctagttacgtatagtaagttcggaacgttcccgaccgaggtcccgtaccggaacggggaaacgggggtctgggagtccgggtctacctcacgtagtagtttacggtgggttaagttaggtttactttacgaatttaagtacgttaacgcgtaacgtacttacgaggttacgcggtacgggcctaacttacaccgtactccgtaccgaagtaacgaacgaacctaccgaaacgtacctcccgtagttactgtacaacgaagtcggaacnctcggtagaacggtcgtaacgaacggtaccgtacggtaccttattacggttattccgggtttaggtccgggtacgggggtcgggtccgggttacgggggggcgtagtacggacggtacgggtcggtaccggggaccgtaccgggtcctacccggg

SEQ ID NO: 174442 - DNA, 638 bp, Homo sapiens
  misc_feature: GYAE6OF02IODOE.21.19.B08.1.454.CMB.1.raw
  modified_base (421)..(421): a, c, t, g, unknown or other
  misc_feature (421)..(421): n is a, c, g, or t
  modified_base (555)..(555): a, c, t, g, unknown or other
  misc_feature (555)..(555): n is a, c, g, or t
tcagtcgtcgctcgcacgaccggtgctcgatttagtgagtcagtaagggggagagaggagccttagccctggattccaaggcctatccacttggtgatcagcactgagcaccgaggattcaccatggaactggggctccgcttgggtttcctagttactattttagaaggtgtccagtgtgaggtgcatctggtggagtcgtgggggaggcctggtcaaggccgtggggggtccctggagtactctcctggtcgcacgcctcgtggactccgccttacacgttacctatagtatagtaaagtggactccgccgaagggtcctacccgaaggggaaacggggtccgttagggacggttggccttccgtcgaacgagtattaggtaggtagtagttagttctatatacttacggcagtactanaggtcgacgagggtaccctagtaccaccgtaactccgtaccagaacgacgaacgtcaaagtactacccgtatacgtctacgactaaagtcgaacgagtcgtacgagtacgtacggaacgacgtacgagttactntacgtatcgtggccgggtggtcggtcgggggtacggcgtacggacgacggtcggtacgggacccggagggtaccccgtccggg

SEQ ID NO: 174443 - DNA, 544 bp, Homo sapiens
  misc_feature: GYAE6OF01DA3V0.40.9.A09.1.454.CMB.1.raw
  modified_base (377)..(377): a, c, t, g, unknown or other
  misc_feature (377)..(377): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaacaaatgagaagaactacttagcttggtaccagcagagaccaggacaacctcctaagttgctctttactggctcgttcccgggagtccggggtcctgacgattcagtgccaggcgggtctgggacagcttcactctcaccntcagcgcctgcaggctgaagatgtggctagtttattactgtcagtcacttggttttcggcggtttctccggttacgtttcgggcgggtacgggaccgtaagggtcgggaggtcgaaaagttggaacgtggttcgggcttcggacctacctattccgtgttccgttac

SEQ ID NO: 174444 - DNA, 525 bp, Homo sapiens
  misc_feature: GYAE6OF01B4DQY.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactggcgtcttcccgggagtccggggtccctgaccgattcagtgccagcgggtctgggacagacttcactctcaccatcagcggcctgcaggctgaagatgtgctagtttatactgtcagcactgtttggcggtttctccgtactttcgggcggtagggaccaagggtcggaggtccaaacggacgttggtcggctggccaccgattctgttccttcgattccccg

SEQ ID NO: 174445 - DNA, 530 bp, Homo sapiens
  misc_feature: GYAE6OF01BJX73.40.9.A09.1.454.CMB.1.raw
  modified_base (408)..(408): a, c, t, g, unknown or other
  misc_feature (408)..(408): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactggctctccggagtccgggtccctgaccgattcagtgccagcggtctgggacagacttcactctcacatcagcgctgcagctgagatgtgctagtttatactgtcngctacgtgtttggccggtttctccgtacgtttcgggacggacgggaccctaagggtcggaggtacaaacggtacgtaggtcggtcgtacgccaccgtacttacgttntccttcncgttcccg

SEQ ID NO: 174446 - DNA, 602 bp, Homo sapiens
  misc_feature: GYAE6OF01ES2H9.40.9.A09.1.454.CMB.1.raw
  modified_base (403)..(403): a, c, t, g, unknown or other
  misc_feature (403)..(403): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactactagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgnggctagtttattactgtcagcacgttgttttggcggtttctccggtacgttttccgggacgggtaacggggtacccgtaaaggggtcgggtaacgggttaccaaaaaaccgggtaacgttagggtacggggtcccttacgggacccaaccccgtaagttacccgttaggttacccttttccgaaacgttttccccccgg

SEQ ID NO: 174447 - DNA, 512 bp, Homo sapiens
  misc_feature: GYAE6OF01EPOJG.40.9.A09.1.454.CMB.1.raw
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcaccatcagcggcctgcagctgaagatgtgcagtttatactgtcagcatgtttggcgttctcgtactttcggcggtagggaccaagggtggaaggttcaaacgtaatggtggctggcctaccatctgtccttctacg

SEQ ID NO: 174448 - DNA, 573 bp, Homo sapiens
  misc_feature: GYAE6OF01CJBXB.40.9.A09.1.454.CMB.1.raw
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccacatctactgcaagtccagccagagtcttttcacacaaccaatgagaagaactacttagcttggtaccagcagacgacaggacaacctcctaagttgcttctttacgtgggtcttccgttcccgggtacggtccggggtccctggaccgtatttcagttcgccaggcgggtcgtgggacagtacttcacgtctcaccatcagccggctgcgaggctagaacgatggngactagtttatactgtcanctacgttggtttcggcggtttcctccgtacgtttcgggcgggtacgggacctaagggtcgggaggtacgaaaacggtacgttggtggccttacggctaacccgtcgttacttgttcccttgtcctttccccg

SEQ ID NO: 174449 - DNA, 517 bp, Homo sapiens
  misc_feature: GYAE6OF01B41OO.40.9.A09.1.454.CMB.1.raw
  modified_base (334)..(334): a, c, t, g, unknown or other
  misc_feature (334)..(334): n is a, c, g, or t
  modified_base (500)..(500): a, c, t, g, unknown or other
  misc_feature (500)..(500): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactgggcgtcttcccggagtccgggtcctgaccgntcagtgccagcggtctgggacagacttcactctcaccatcagcgcctgcaggctagaagatgtgctagtttatactgtcagtctacgttgttttggcgttctccggactttcgggcggtacgggaccaagggtggacggtacaaacggtaactggaggctgcactntctgtcttcgattcccg

SEQ ID NO: 174450 - DNA, 519 bp, Homo sapiens
  misc_feature: GYAE6OF01ENQZS.40.9.A09.1.454.CMB.1.raw
  modified_base (401)..(401): a, c, t, g, unknown or other
  misc_feature (401)..(401): n is a, c, g, or t
  modified_base (513)..(513): a, c, t, g, unknown or other
  misc_feature (513)..(513): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctagaagntgtggctagtttatactgtcagctacttgtttggcgtttctccgtacgtttcggcggagggaccaagggtggaggtacaaacgtactgtggctgcaccgtatctagtcttcnttcccg

SEQ ID NO: 174451 - DNA, 506 bp, Homo sapiens
  misc_feature: GYAE6OF01DFCGI.40.9.A09.1.454.CMB.1.raw
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactactagcttggtaccagcagagaccaggacaacctcctaagttgctctttactgggcgtcttcccgggagtccggggtccctgaccgattcagtgccagcggtctgggacagacttcactctcaccatcagcggcctgcaggctgaagatgtggctagtttattactgtcagtcactgttttggcggtttctccgtactttcggcggagggaccaaggtggaggtcaaacgactgtggctgcacatcntctnatccc

SEQ ID NO: 174452 - DNA, 569 bp, Homo sapiens
  misc_feature: GYAE6OF01BL1R3.40.9.A09.1.454.CMB.1.raw
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgcaagtccagacagagtcttttcacacaaccaatgagaagaactacttagcttggtaccagcagagaccaggacaacctcctaagttgctcttttactgggcgttcgttcccgggagtcccggggtcctcggaccgtattcgagtcgccaggcgggtcgtgggacagactcactcncacatcagcgctgcagctagaagntgtgctagtttatactgtacagtctagtttggtttcggccgtttcctccggttacgtttccgggacggacgggtaccgtaagggtcggaacggtaaccgaaacggtacgttggtcggccgtggaccctaaccttagttcccgttcgttcccttcgtacccg

SEQ ID NO: 174453 - DNA, 571 bp, Homo sapiens
  misc_feature: GYAE6OF01BDCX5.40.9.A09.1.454.CMB.1.raw
  modified_base (341)..(341): a, c, t, g, unknown or other
  misc_feature (341)..(341): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaaactacttagcttggtaccagcagagaccaggacaacctctaagttgcttctttactgggtcgtccgttccgggacggtccgggtccctgaccgnttcgagtcgccgaggcggtcgtgggacaggacttcgactcctacaccatcagcggcctgcgaggctgaagntgngctagtttatacgtgtacngacctagtttggttttcgggccggtttcctccggtacgtttcgggacgggtacgggaaccgtaagggtggtaggtacgaaaacggtacgtggtcggtctcgaccaaccgtacttcttaggttccttcgcgttccccg

SEQ ID NO: 174454 - DNA, 510 bp, Homo sapiens
  misc_feature: GYAE6OF01CQ4H3.40.9.A09.1.454.CMB.1.raw
  modified_base (395)..(395): a, c, t, g, unknown or other
  misc_feature (395)..(395): n is a, c, g, or t
  modified_base (504)..(504): a, c, t, g, unknown or other
  misc_feature (504)..(504): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactggcgtcttcccgggagtccgggtccctgaccgattcagtgccagcggtctgggacagtactcactctcaccatcagcgcctgcagctgaagntgtgctagtttatactgtcagctacttggtttggcgtttctccgtactttcgggcggaggacctaagggtggaggtcaaacgtactggtcggctgcacatctgtcttcnttcccg

SEQ ID NO: 174455 - DNA, 579 bp, Homo sapiens
  misc_feature: GYAE6OF01DUVXW.40.9.A09.1.454.CMB.1.raw
  modified_base (403)..(403): a, c, t, g, unknown or other
  misc_feature (403)..(403): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgcttcttttactgggcgtcgttcccgggagtcccggggtccctgaccgattcagtgccgaggcggtctgggacagacttcactctcacatcagcgcctgcaggctgaatntggtgactagttttatactgtcagtctactttggttttcggccggtttcctcccggttacgttttcgggacgggtaacgggaccgtaaaggggtcgggacggttacaaaaccggtaacgttgggtcggacttcggaccctaaccgtattccgttagttcccttgtctttacccccg

SEQ ID NO: 174456 - DNA, 562 bp, Homo sapiens
  misc_feature: GYAE6OF01A9DN7.40.9.A09.1.454.CMB.1.raw
  modified_base (412)..(412): a, c, t, g, unknown or other
  misc_feature (412)..(412): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagttctttttcacacaaccaatgagaagaactacttagcttggtaccagcagagaccaggacaacctcctaagtgctctttactggcgtcgtccgggagtccgggtcctgaccgatcagtcgccagcgggtctgggacagactcactctcaccatcagcgcctgcagctgagatgtgctagtttatacgtntcgagtctacgttggtttcggccggtttcttccggtacgtttcggggacgggtacgggaaccgtaaggggtcgggtaaggtaaccgaaacggtacgttggtcgggtcctacggaccctaccgtattacccgttggttcccttcgtacccg

SEQ ID NO: 174457 - DNA, 544 bp, Homo sapiens
  misc_feature: GYAE6OF01BVBF9.40.9.A09.1.454.CMB.1.raw
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttacnggcgtcttcccgggagtccgggtcctgaccgattcagtgccagcggtctgggacagacttcactctcacatcagcgctgcagctgaagntgtgctagtttatactgtcagctacgttgttttacggcggttctcccgtacgtttcgggcggtacgggaccgtaagggtcggaggtaccgaaacggtaacgtggtacgggcttaggcctaaccgtagttcctagttccttcgactttccccg

SEQ ID NO: 174458 - DNA, 606 bp, Homo sapiens
  misc_feature: GYAE6OF01DJHOV.40.9.A09.1.454.CMB.1.raw
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgagacgggccaccatctactgacaagtccagacagtagttcttttcacacaacaatgaagaagaactattagcttaggtaccagcagacgaccaaggaccaacctacctaagttcgcttctttacgtcgggcgttccgtcccgggacggtcccgggtcctgaccgtatcgagtcgccgtaggcgggtcgtacgggactacgtaccttcgacttccgaccaccatccgaggccggtccgtgcgtaggctaggaacgtagtggtgtactagttttactacgtgtactagcttagttggtttcggccgtttccgtacggttacgtttcgggcgggtaacgggacgtagggtacgggaacgtaacgtaaacggtattggtcgggcttcgacccgtaccattccgtgttcctcgttacccg

SEQ ID NO: 174459 - DNA, 702 bp, Homo sapiens
  misc_feature: GYAE6OF01DOLT0.40.9.A09.1.454.CMB.1.raw
  modified_base (510)..(510): a, c, t, g, unknown or other
  misc_feature (510)..(510): n is a, c, g, or t
tcagtctagcgactcacgaccggtgctcgatttagcgagacgcgcagggggagctacaacaggcaggcaggggcagcaagatggtgttgcagactcaggtcttcattttctctgttgctctggatctctgtgcctacggggacatcgtgatgaaccagtctccagacgtccctggctgtgtctcgtgggcgaggaggccacatctactgcaagtccagacaggtcttctttacacaacaacaatagaagaacaacttatagtcttacggacagcgagacgacgacgacctaacctcgtaagttcgtacttcttttacggcggtccgttccgtacccggggtaccggtcccgggtccctacggtaccgtacgttacgaggtccgacggtacgggtccggttggacggtaacgacgtaccttacctaccctcgtacccactacgtccgaggtccccgtgcggcacggtcgtaaggaatggtaggtactaagttagttttaactcgtacggtnaacgttccgttacgtttcgggtttaccgggtcccgtttacggtaccggtttccggggtaccgggtacggggaaaccgggttacggaaaccggggttgggtaaaaccgggttaaccgaaacgggtttcgtggggtcccgtacgttaccgaccccgttaaactccgggtttcgtttaaccgtcgtttaaccccg

SEQ ID NO: 174460 - DNA, 545 bp, Homo sapiens
  misc_feature: GYAE6OF01C2FGR.40.9.A09.1.454.CMB.1.raw
  modified_base (277)..(277): a, c, t, g, unknown or other
  misc_feature (277)..(277): n is a, c, g, or t
  modified_base (412)..(412): a, c, t, g, unknown or other
  misc_feature (412)..(412): n is a, c, g, or t
  modified_base (493)..(493): a, c, t, g, unknown or other
  misc_feature (493)..(493): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggcccaccatctactgcaagtccagacagagttcttttcacacaaccaatgagaagaaactacttagcttggtaccagcaaganaccaggacaacctacctaagttgctcttttactgggcgtcttcccgggagtcccgggtccctgaccgattcagtgcccagcgggtctgggacagacttcacctcgtcaccatcagccggcctgcaggctgaaagntggtggctagtttattactgtcagctacttgttttcggcggtttctccgtacgttttcgggcggtacgggaccgtacgggngtagggtacaaacggtacgtggtcggctgaccacactctcgtcttcgtaccg

SEQ ID NO: 174461 - DNA, 542 bp, Homo sapiens
  misc_feature: GYAE6OF01A2S3L.40.9.A09.1.454.CMB.1.raw
  modified_base (338)..(338): a, c, t, g, unknown or other
  misc_feature (338)..(338): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgnttcagtgccagcgggtctgggacagacttcactctcaccatcagcgcctgcaggctgaagntggngctagtttatactgtcagctacgttggttttcggccggtttctcccgtacgtttcgggcgggtagggtacccaagggtggaggtacgaaacggtactggtcggctggccaccgtatcgtagttccttcgactttccccg

SEQ ID NO: 174462 - DNA, 657 bp, Homo sapiens
  misc_feature: GYAE6OF01BVDDJ.40.9.A09.1.454.CMB.1.raw
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgcaagtccagacagagttcttttcacacaaccaatgaagaaagaactacttagtcgttggtaccagacagaacgaccgaggaaccaacctacctaagttgcttactttacgtcgggtcgttcgttcccgggacggtcccggggtccctcggaccgtattcgagtcggcctaggcgggtcgtgggacagtacttcactctcactactcacggccgctgacaggctacggaagagttggtaggtaccttaaggttttactacgttggttacacgtacgttaacgtttgggttttcgggaccgggttttccgtacccggttacgggtttccgggacggggtaacgggtaacccggtaaggggttcggaaacgggttaccgaaaaccggtacggttagggtcgggaccgttccggacctacccgtacttccgtcgtttcccgttacgttaccg

SEQ ID NO: 174463 - DNA, 617 bp, Homo sapiens
  misc_feature: GYAE6OF01DE2I5.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttctttttcacacaaccaatgaagaagaactactagcttggtaccagcagagaccaggacaaacctcctaaagttcgcttctttacgtgggtcgtcgttcccggggacgtcccggggtccctcggaccgtattcgagttcgccaggcgggtcgtagggacagtactcgactcctacaccatcgacgtccggcctagcaggtctgaagtatgtcggcttaggtttactacgtgtacagtctacgtttgttttcgggccgtttcgtccgttacggtttcgggaccgggtagggaacccgtaagggtggaacgggttaccaaaaacgggtacgttgggtacggtccgttacggcccaaccggttacttaccgttgttacccttcgttacttacccccgg

SEQ ID NO: 174464 - DNA, 566 bp, Homo sapiens
  misc_feature: GYAE6OF01EAWK9.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaacgtccagccagagttcttttcaacacaaccaatgagaagaactacttagcttagtaccagcagagaccaggacaacctctaagttgcttctttactgggactcgttcccgggagtccggggtccctgaccgtatcgagtcgccgaggccgggtctgggactagaccttcgactctcacatcacggcgtcctgccgagctgaagtgtggtgtcgttagttacttactcgtcagcctagttgttttacggcgtttcgtccgttacggttcggcgggtacgggacgtaagggtggacggtaccaaaggtacgtggtcggctcggaccaccgttatccgttacggtccttccgctttcccg

SEQ ID NO: 174465 - DNA, 686 bp, Homo sapiens
  misc_feature: GYAE6OF01D9WFX.40.9.A09.1.454.CMB.1.raw
  modified_base (307)..(307): a, c, t, g, unknown or other
  misc_feature (307)..(307): n is a, c, g, or t
  modified_base (653)..(653): a, c, t, g, unknown or other
  misc_feature (653)..(653): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacgggacatcgtgatgaaccagtctccagagtccctggctgtgtctctggcgagagggccaccatctactgcaagtccagccagtagttctttttcacacaaccaatgagaagaactacttagcttggtaccagcagacgaccaggacaacctacgtaagttgcttctttacgngggtcgttccgttccgggtacggttcccgggtccctacggtaccgtacttcgagtcgccgtagggtccgggtcgtcgggaactacgtaccttcgacttccgtacctacctaacttccgaacggccggtccctaggaccgagggtcttaggaaacgtagttcgggtcgggtacttaaggtttttacttaacgttcggttacgtaacgtccttaacggttttcgggtttcggtaccggtttccgttaccggttacggtttccgggacgggtaccgggtaacgtaagggtcggtaacggtaccgtaaaacggtacgttagggtcggtccgtacggtacctaaacccgtntttacccgtgtttaccttccgtacgtttccccg

SEQ ID NO: 174466 - DNA, 561 bp, Homo sapiens
  misc_feature: GYAE6OF01BUSDI.40.9.A09.1.454.CMB.1.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtcttttcacacaaccaatgagaagaactacttagcttggtaccagcagagaccaggacaacctcctaagttgctctttactggcgtctcccggagtccgggtccctgaccgattcagtgccagccggtntgggacngacttcactctcaccatccagtccgcctgccaggctaggaagatgtggactagtttattactgtacacgtctacgttgtttcggcggtttctcccggtacgttttccggggacggacgggtacccgtaaagggtcgggtaggtaacgaaacgtaacgtggttggccttaggcctaaccgattcgtcggttcttcgtaacccg

SEQ ID NO: 174467 - DNA, 751 bp, Homo sapiens
  misc_feature: GYAE6OF01B4V49.40.9.A09.1.454.CMB.1.raw
  modified_base (252)..(252): a, c, t, g, unknown or other
  misc_feature (252)..(252): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgaggacgggccaccatctactgcaagtccagccagacgttcttttcacacaaccaatgaagaanaactactagtcgttacgtaccagacgagacgaccgacgaacctaacctacgttagttcgtcttacgtttacggtcggtccgttccggttcccgggtacggttcccgggtcccgtcgtaccgtactcgtacgtcgcgtacggtccggtcgtacgggactacgtactacctactcctaccacctacgtaccgaccggtcccggtccgtcggacgtacgggtacgtaaggtaagtaggtcggttacggtacgtttaacggtttacgttacgttacgtacgtacggttaccgtttacggttttcgggttttaccgggttcccggtttccggttacccggtttacgggtttccggggaaccggggtaccggggtaaccgggtaacggggtacgggtaaaccgggttaaaccggtaaaccggttacggttacgggtccggtccgtaccgtaacccgtaccgttacgtttaccgttaccgtttacccttccgtacccgtttccccg

SEQ ID NO: 174468 - DNA, 726 bp, Homo sapiens
  misc_feature: GYAE6OF01B6OTM.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgccgtacggggacatcgtgatacgaaccagtctcgagacgtccgtggctgtgtctcgtggcgaggcggccacgactctactgacacgtccagcctagtacgtttcgtttttaccaacacaaacctaagtagaacgaaacgtaacttacgttagtcgttacggtaccagacgagacgacacggacctaacctacgtagtcgtcttacgtttacgtcggtccgtaccggttacccggtacggtcccgggtccgtacggtaccgtacgttcgacgtcgaccgtacggtcggtacgtacggactacgtacttacgactactacgtacctacgtacgaccgcgtctcggacgcggtacgtaggaacggttagtcgggtacgttaccttaagttttaccgttacctggttacgtcgttaaccgttacggtttttggttcggttaccgtttcggtttccccggtacggtttcgggaacgggttccgtaaacggggtacgggttaccgggtaaacgtaaccgtaaacggttcggtaggtccggtaaccgttccggaaacttacggttaccctcgttaccggttccttaccgtacccgtttccccg

SEQ ID NO: 174469 - DNA, 598 bp, Homo sapiens
  misc_feature: GYAE6OF01AD544.40.9.A09.1.454.CMB.1.raw
  modified_base (302)..(302): a, c, t, g, unknown or other
  misc_feature (302)..(302): n is a, c, g, or t
  modified_base (559)..(559): a, c, t, g, unknown or other
  misc_feature (559)..(559): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacgggacatcgtgatgaaccagtctccagagtccctggctgtgtctctgggcgaggagggccaccatctactgcaagtccagccagagtcttttcacacaaccaatgagaagaactacttagcttggtaccagcagagaccaggacaacctctaagttgcttctttacngggcgtcgttccgggaggtcccgggtcctgccgtatcgagtcgccgtaggcggtcgtacgggacacgtacttcctactcctcaaccctagttccaacggccggcccgttgaccgacgggtacgttacgaaacgtagttcggtcggacgtttaaggtttattaccgtgttaccagtaccttacgttggtttacggcgtttaccgtcgtacgtttcgggcggtacggaccgtaggtggtacggtacaaacgtcgttggngtccgtcgaccacgtnttcgtnttctccgtattccccgg

SEQ ID NO: 174470 - DNA, 921 bp, Homo sapiens
  misc_feature: GYAE6OF01CJ34Q.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtcgccgtacgggacatcgtgatacgaaccagtcctccagacgtcccgtggctgtgtctcgtgggcgaggacggccaccatctactgacaacgtccacgaccgtagtacgtttccttttaccaaccaacctaacaagtagaagtaaacgtaacttacgttagtcgttacggtaccagacgaacgacgaccgaacgaacctaacctacgtaacgttcgtaccttcgtttacggtcggtccgttccggttcccgggtacggttcccgggttaccgtacggtaccgtacgttccgtacgtccggaccgtacgggtccgggtacggtacggacgtacgtaccttaccgtaccttacctaccactacgtccggacggcccgtacgtggaacctagggtctaagggaacgttcgggttagggaccgggtttaatttaaacgggtttttaaactaccggttcggtaaccgaggtttaacccgtttttacggggtttttccgggtttaacccggggttttccccgggtttaacccccggtttacccggggtttaacccgggggttttaccgggggggaacccgggggttaaaaccggggtaaccggggttaaagggggggtttaccccgggtaaaaaaccgggggttttaaacccggtaaaaacccgggttacgggtttgggggttaaccccgggtcccggttttaaaccccggtaccccgtaaaaccgttttacccggggtttcccttttaccggtttaaaccccgtttttccccggttaacccccgttttccccccgggg

SEQ ID NO: 174471 - DNA, 676 bp, Homo sapiens
  misc_feature: GYAE6OF01CTP9N.40.9.A09.1.454.CMB.1.raw
  modified_base (243)..(243): a, c, t, g, unknown or other
  misc_feature (243)..(243): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctcgtgggcgaggagggccaccgatctactgcaagtccagccagagttcttttcacacacatganaagaactacttagcttaggtaccagcagagaccaggacacctcctaagtgtcttctttacgtcgggctccgttcccgggacgttcccgggtcccgtcgaccgtacttcgacgttcgccgtacgggccgggtactacgggaccaggtacctttacacttaccgtaccaacccgtacttacgaacggcccggtccgttacggaccgacggtcgtacggaagacgttcggtacggtattaacgttttacgttacgttgtacgtcgtacgtaacgttttcgggttttcgggttccggtttcccgttacccggttacggttttccgggccgggtaagggtaccggtaaggggtaccggtaagggtacctaaacggtacgttagggtacggtccgtacgacctacccgtacttacgttcgttccttcgtccttaccccg

SEQ ID NO: 174472 - DNA, 780 bp, Homo sapiens
  misc_feature: GYAE6OF01BS74I.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtcgccgtacgggacatcgtgatgaaccagtctccagacgtccgtgctgtgtctgtgggcgaggacggccacactctactgacaacgcccagccagtacgtttcttttacacaaccaaacctaagtacgaagaaacgtaaccttaacgttacgtcgttacggtaccagacaagaccgaaccgaacggaacctaaccgtaccgttaacgttcgtaccgttttacgttttacggtcgggttaccgttcccgggttacccggggtaccgggttccccggggttacccgttaccggtaaccgttacgttacggtaacggtccggaccggtacggggtccgggttacggtacgggtaaccgtaacgttacccttacccgtaccttaccctaaccgtacccgtacgtaccgacgggcccgtccgtaggacgtacggtcgtaaaggaacgtcggttaggtacggttactttaacgtttactacggtcgtacgtacgttacgttcggttttacggtttccgggtaccgtttccgttaccggtttacgggttccgggaacgggtaccggtaacggtaggggtaacggtaccgtaaacgaaacggttgtacggcgtactacgaccttacgtacgttcgttacgttcctacttccgttcccccg

SEQ ID NO: 174473 - DNA, 587 bp, Homo sapiens
  misc_feature: GYAE6OF01DU4XA.40.9.A09.1.454.CMB.1.raw
  modified_base (307)..(307): a, c, t, g, unknown or other
  misc_feature (307)..(307): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagacgggccaccatctactgcaagtccagccagagttctttttcacacaaccaatgagaagaactacttagcttaggtaccagcagagaccaggacaacctcctaagttgtctctttacnggtcgtccgttccgggagtcccgggtcctgaccgtattcagtcgccgagcgggtctgggacagtactcactctcacatcagccgtctgcgacggctagagtatggtgacttagtttatacgtgtacagtctacgtttggtttcggtacggtttctcccggttacgtttccgggacgggtacgggtaacccgtaagggtacggtacggtaaccaaaaggttaccgtagggttcgtacggtacgaccaccgtattcctggtttacctcgttccgttaccccg

SEQ ID NO: 174474 - DNA, 739 bp, Homo sapiens
  misc_feature: GYAE6OF01B6235.40.9.A09.1.454.CMB.1.raw
  modified_base (224)..(224): a, c, t, g, unknown or other
  misc_feature (224)..(224): n is a, c, g, or t
  modified_base (520)..(520): a, c, t, g, unknown or other
  misc_feature (520)..(520): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctcgtggtcgccgtacggggacagtcgtgatacgaaccagtcctaccagacgttccccgtggtctgtgtccgtcgtgggcgaggacggccaccatctacngacgaacgtccaagacagtacgtttcttttacacaacaaaccaatacgaaagaaacgtaactaacgttacgtacgttacggaaccagacgaagaacgaaccgaacggaaccctaaccctaccgtaagttcgtacgtttaccgttttaacggtcgggtcccgttacccggttacccgggaccgggttccccggggtacctacggaccgtacttcgaacgtcggaccgacggtccggtacggtaggaacctacgtaccttactacctaccaccaacctacgtccgaccggtccgtacncgacgtacgacgttaagaagtcgtaggttatacgtttaacgtttatacgtacgtacacgttacgttacggtttggtttaccggtccgtttaccctaccggttcgggttacccgggagggaacggtacggtacgggtaggtaaacggttaaccgaaaaggtaccggttggtaacccgcgtacgacctacccgttagttccttacgttcctaccgtacccg

SEQ ID NO: 174475 - DNA, 799 bp, Homo sapiens
  misc_feature: GYAE6OF01CPYC2.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgccgtacgggacatcgtgatcgaaccagtcctcagacgtcctgtctgtgtctcgtgggcgagacggccacactctactgactacgccagccagtagttcttttacacaacaaccagtgaagaacgtaacttactagtcgttacgtaccagtacgaacgacgaccgaggactaacccgtacgttaagtcgtactttctttaacggtccggggtaccgttccggttacccggggtaccggttccccggggttacccgtacgtaacccggttattccgtacggttaccgaccggtaccggggtccgggttcggtacgggaacctacggttacgttcctaccgttcctacccgaccgtacgtccggaacggtccggacccgttggaccgtacggtagtacgggtaactggtcggttacgacggttttaactttacgtcgttccgtaacggttcttaaccggttttacggttttccggggtttaccgttaccggttttcccggttacccggttttaccgggtttaccggggaaccggggttcgggtaaaacccgggtggggttaccgggtaaacgtaaacccgttaaacggggacgtttccggggtggtaccctccgggtaaacctacccggttacttacgtttccgtaaccttcccgttacccgtttccccccg

SEQ ID NO: 174476 - DNA, 805 bp, Homo sapiens
  misc_feature: GYAE6OF01CJM17.40.9.A09.1.454.CMB.1.raw
  modified_base (780)..(780): a, c, t, g, unknown or other
  misc_feature (780)..(780): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgccgtacgggacatcgtgatgaaccagtctcagacgtccgtggctgtgtctcgtgggcgaggacgggccaccagtcctactcgacgaacgtccacgaccgagtacgtttcctttttacactaaccaacctaagtagaagaaagtaaccttaacgttagtacgttacggtaaccacgtcgaaggaacgaccgaacggaaccctaacccgttaccttaaacggtttcgtaccttttacgttttaccgtcggggttccgttacccggttcccggggtacgggttaccccggggttaccctacggtaccgtacttccggtacggtacgccggtacgggtccgggtacgtacgggtacgtaacgttaccgttaccaccgttctacccgtacctacgtaccgacggtcccgggccgttggaccgtacggggtacttacggggaatttaacggttcgggttacggtaccccgttttaaaggttttaccgttacccgtcgggttaaccctaaggttccgtttaacgggttttgggtttacccgggttcggttttaccccgttaccggttaccgggtttaccggggaccgggggagttaaaccgggtaggggtacgtacgtaaccggtaaacggtacgttgggacgcgttcgactacgtnttcgtattcttacgccgtttacccg

SEQ ID NO: 174477 - DNA, 794 bp, Homo sapiens
  misc_feature: GYAE6OF01AOB2N.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgccgtacggggacatcgtgatgaaccacgtctccagacgtcctggtctgtcgtctcgtgggcgaggacgggccacactctactcgacaacgtccacgacagtacgtttcttttacacaacaaccaatgaagaacgtaacttacttagtcgttacggtaccagacacgaacgacccgaggacctaacctacgtacgttcgtactttacgtttacggtcgggtccgttccggttacccgggacgggttcccgggtacccgtacggtaccgtacgttacgtacggtcgtaccggtacggggtccgggtaccggtacgggaccgtaacgttaccgttaccgtacctaccgtacctaaccgtacgttacggacccgggtcccggtaccgttacgggacggtacgggtacggttaaacggaacgttcggttacggtcggtttaacgtttacgtttacttaccggttactcggtaacgtcgtttacgggtttaggttttccgggttaccgttaccgtttacccggtaggtttaccggggcgggttaacggaacgggtaaacggggtcggtaaacggtaaccgtaaaccgggtcggttacgggaccgtcggtaccaaccggttaccttaacgttccggttactttacccgtttcgtaacccggtttacccccg

SEQ ID NO: 174478 - DNA, 907 bp, Homo sapiens
  misc_feature: GYAE6OF01BIPU8.40.9.A09.1.454.CMB.1.raw
  modified_base (198)..(198): a, c, t, g, unknown or other
  misc_feature (198)..(198): n is a, c, g, or t
tcagtctagcgactcacgaccggtgctcgatttagcgagacgcgcgagggggctacaacaggcaggcaggggcagcaagatggtgttgcagacccaggtcttcatttctctgttgctctggtatcgtcgtggtcgaccgtacggggacagtcgtagatacgaacctagtcctacagtcgtcccgtgctgtgtcgtcgngggacgaggaccggaccaccgtatactacgtacgacgtaacggtccgacggtacctacggttaccttttaccttttaaccaacctaaacgtaaaccgaaagttaaggaaaggtaaaaccgttaaccgtttaacgttacggtaccggtttaacccggtaaccgacggtaaccgtaaacggaaaccggtaaacccggtaaccggtaaacccttaaaccccgttaacggtttaaggtttccgttaccgtttttaccgtttaaccggtccggggttcccgttttaacccggggggtaccccgggtaacccggggtttcccccggggttaccccgttaaccgggtaaccggttaccgttaccggaacggtcccggtaaccgggtccgggtaccgggtcgggtaaccggaacggtccctaacgtttacccgaccgtcctaccgtaacctcggtacgacccggcggtactcggacgtggtacacggtaggttcgtaggtcgtaactttaacgtttcgtacgaggttacgtacgtaccggttacggttttgggttacccggttccgttacgtttacccgggttacggtacgggtaccgggtaacgggtaaccgggtagggtacggtaaacggtacccgtaaagggttacggttggtaccggtacctccgtaacgtaccgttatccggtttaaactccgtaaccgttcccttaacccg

SEQ ID NO: 174479 - DNA, 864 bp, Homo sapiens
  misc_feature: GYAE6OF01BYJVD.40.9.A09.1.454.CMB.1.raw
tcagtctagcgactcacgaccggtgctcgatttagcgagacgcgcgagggggctacaacaggcaggcaggggcagcaagatggtgttgcagacccaggtcttcatttctcttgttgctcgtggattctcgtggtcgaccggtacggggactagtcgtagactacgaacccgtagtcctaccgaggtaccgtcccgtggtctggtcgtccgtcggtgggacgtaggacggccaccgatctacgtagacaacgtccacgacgtaagtcgtttacctttacgaacctaacaaaccgtaagtacggaagtaaaacgtaacttacttaacggtcgttacggaaccgtaagacgaacgtaaccggaaccgaacggtaaccctaaccgttacgttaacggtacgttaccgtttacgtttacggtcgggtaccggttacccggtccgggtaccggttcccgggccgtacgtaccgtagttcgacggtacgacgtacgggtcggttacgacggacgtacggtaaccttccgacttaccgtactaaccgtacgtaccgaagggcccgtacgtcgaacggtacggtacgtaacggtaacgttagtcgggtaccggttaagtttaacgtttaacgtacgtacgttaaccgtacgtaccgttaggttttccggtttacgggttccgttacccgggttacccgggtttacggttaacccgggagggttaacccggaacgggttaacggggtaaccgggtaaaccgggttaaaccgtaaacgggttaccggtaacggttacggttaaccggtaacccgtaccgtaaccgtttaccggaccgttttacggtcgtttaaacccgtcccgggtttaaccccc

SEQ ID NO: 174480 - DNA, 730 bp, Homo sapiens
  misc_feature: GYAE6OF01B9F6S.40.9.A09.1.454.CMB.1.raw
tcagtctagcgactcacgaccggtgctcgatttagcgagacgcgcagggggagctacaacaggcaggcaggggcagcaagatggtgttgcagacccaggtcttctatttctctgttgctctggatctcgtggtcgccgtacggggacagtcgtgatcgaaccagtctccagacgtccctggctgtcgtctcgtgggcgaggacggccacatctactgcgtaacgtccgaagactagtacgtttcttttacgaacctaaccaacaataggaagaaacgtaacgttacttaacgtacgtttacggaccagacgaaggacgaaccgtacgaacctaaccttacgttaacgttcgtaccgtttcgtttacggtccgggttccggttcccggttcccggggtaccggttccccgggttccgtacgtacggttacgttcgcgtacgcggtacggtcgggtacggtacgggactacgtccttacgtacctccgtaacctaccgtacgtccgcggtcccgtcgtacgacgtacggactaacggagtagtcgggttacgtacgtttaatttacgttactcgtacgtacgtcgttcgttttcggttacgggttccgttaccggtttaccgttacggttcggggaccgggtacggaaggttacgggacgtacggtaccgtaaacggttgtggtcggtatcccgtacgtcccgttcgttaccgtttcgttcttccgtacccg

SEQ ID NO: 174481 - DNA, 729 bp, Homo sapiens
  misc_feature: GYAE6OF01DYAOM.40.9.A09.1.454.CMB.1.raw
tcagtctagcgactcacgaccggtgctcgatttagcgagacgcgcgagggggctacaacaggcaggcaggggcagcaagatggtgttgcacgacccaggtcttcatttctctgttgctcgtggtactctcgtggtcgccgtacgggacagtcgtagatcgaacctacgtcctaccgagtacgtccgtcggtcgttcgtcgtcgtcggtggggcggaaggacggaccacctacttactacgtcgacgtaacgtaccacgtaccgtagttaccgtttcttttaccgaacctaaccaaaccgaagtaagaaacgtaaacgtaaacttacgttaacgtcgttaacggtaacaagacgaacgtaacgaaccgacgaacctaacctacgttagtcgtcgtttcgttacggtcggtcgttccggtaccggtaccggtccggtaccgacgtacgtacgtacgcgtcgacgtacggcggtcggacgtacgtctaccgtctacctactacactacgtcgaccggtacgcgtcgacgcgtactaaggaacgtggtacgttggttacttagttaactcgttacgactacgtagttccggtttggttacggttccggtttacgtccggtttcggtacgggacgggtacgtacgggtacggaggtaaccgtaacggtaacgttccgtaggtccgtacgacctacccgtacgtcgttaccgtactttcgtccgttcgtaccccg

SEQ ID NO: 174482 - DNA, 511 bp, Homo sapiens
  misc_feature: GYAE6OF02F4TKC.40.9.A09.1.454.CMB.1.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaacaaatgagaaagaactacttagcttggtaccagcagagaccaggacaacctcctaagttgctctttactggtcgtcttcccgggagtccgggtccctgaccgattcagtgccagcgggtctgggacagacttcactctcacatcagcgctgcagcngaagntgtgcagtttatactgtcagcacttgtttggcgtttctccgtactttcggcggtaggaccaggtggacggtacaaacggactgtggcttgccacctagtctcgttcttctacg

SEQ ID NO: 174483 - DNA, 534 bp, Homo sapiens
  misc_feature: GYAE6OF02I9XOY.40.9.A09.1.454.CMB.1.raw
  modified_base (394)..(394): a, c, t, g, unknown or other
  misc_feature (394)..(394): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactggcgtcttccgggagtccggggtcctgaccgattcagtgccagcggtctgggacagacttcactctcacatcagcgcctgcaggctgaagntgtggctagtttattactgtcagctacgttgttttggcgtttctcggtactttcgggcggaggtaccgaagggttggacggtacgaaacggacgttggtcggcttaggcctaccgtattccgtggttcttacgattcccg

SEQ ID NO: 174484 - DNA, 520 bp, Homo sapiens
  misc_feature: GYAE6OF02FIAK5.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcgcctgcaggctgaagatgtggctagtttattactgtcagcacttgttttggcggtttctccgtacttttcgggcggtagggaccaagggtggaggtcaacggaactggtggctgcaccatcctgtcttcattcccg

SEQ ID NO: 174485 - DNA, 530 bp, Homo sapiens
  misc_feature: GYAE6OF02HD4DI.40.9.A09.1.454.CMB.1.raw
  modified_base (403)..(403): a, c, t, g, unknown or other
  misc_feature (403)..(403): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggccgtcttcccgggagttccggggtccctggaccgattcagtgccagcgggtctgggacagacttcactctcacatcagcgctgcacgctagaacgngtgtggctagtttattactgtcagctagttggtttgtcgttcgtccgtacgttcggcggagaccgtaggtggacgtacaacggtactggtgcgtcgactaccattcgtcgtcttacgactttccccg

SEQ ID NO: 174486 - DNA, 525 bp, Homo sapiens
  misc_feature: GYAE6OF02GI8VE.40.9.A09.1.454.CMB.1.raw
  modified_base (401)..(401): a, c, t, g, unknown or other
  misc_feature (401)..(401): n is a, c, g, or t
  modified_base (508)..(508): a, c, t, g, unknown or other
  misc_feature (508)..(508): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtcttttcacacaaccaatgagaagaactacttagcttggtaccagcagagaccaggacaacctcctaagttgctcttttactgggcgtcttcccgggagtcccggggtccctgaccgattcagtgccagcgggtctgggacagacttcactctcaccatcagcggcctgcaggctgaagntgtggctagttttattactgtcagctacttggttttggcgtttctccgtacgttttcgggcggagggaccagggtggaggtacgaacggactggtggcgtgcacctntcgtgtcttcattcccg

SEQ ID NO: 174487 - DNA, 505 bp, Homo sapiens
  misc_feature: GYAE6OF02IO22N.40.9.A09.1.454.CMB.1.raw
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
  modified_base (491)..(491): a, c, t, g, unknown or other
  misc_feature (491)..(491): n is a, c, g, or t
tcagtctagcgactcacgaccggtgctcgatttagcgagacgcgcaggggcgtacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactggcgtcttcccgggagtccggggtcctgacgatcagtgcagcggtctggacngactcacnctcaccatcagcgcctgcagtctgaaagntgtggcagttttatactgtctagcactgtttgcgttcaccgtctttcgcggaggaccaaggtgaggttcaaacgaacgtgtggcttacgcgaccatccngtcgttcattcccg

SEQ ID NO: 174488 - DNA, 528 bp, Homo sapiens
  misc_feature: GYAE6OF02GZ3QJ.40.9.A09.1.454.CMB.1.raw
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (510)..(510): a, c, t, g, unknown or other
  misc_feature (510)..(510): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttacngggcgtcgttcccgggacgtccgggtccctgaccgattcagtgccagcggtctggacagactcactctcaccatcagcgctgcnggctagaagntgtgcttagtttatactgtcagctagttggtttcggcgtttcctcgtacgtttcgggcgggtaggaaccgtaagggtcggaggtacaaacggtactggtcggctgaccaccgtntctcgtcttcacttcccg

SEQ ID NO: 174489 - DNA, 514 bp, Homo sapiens
  misc_feature: GYAE6OF02GM5K7.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcggtctgggacagacttcactctcaccatcagcggcctgcaggctgaagatgtggctagtttattactgtcagcacttgttttggcggtttctccgtactttcggcggaggaccaagggtggaggtcaaacgaactgtcggctgcacatctgtcttcattcccg

SEQ ID NO: 174490 - DNA, 557 bp, Homo sapiens
  misc_feature: GYAE6OF02GG7IP.40.9.A09.1.454.CMB.1.raw
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagtctagcgactcacgaccggtgctcgatttagcgagacgcgcgagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccgatctactgcaaggtccagccagacgtctttttcacacaaccaatgagaagaactacttagcttaggtaccagcagagaccaggacaacctcctaagtgctctttacgnggctcgttccgggagtccgggtcctgaccgattcagtgccagcggtctgggacagacttcactctcaccatcagcgctgcaggctagagatgngctagtttatacngtcagctagttgtttggccgtttctccggtactttcgggacggtaggaccgtaagggtggtacggtacgaaaccggtcgtggttcgggaccttaggacctaaccgtacgtttccgttagttcctttacgacttttacccccgg

SEQ ID NO: 174491 - DNA, 535 bp, Homo sapiens
  misc_feature: GYAE6OF02H0QJP.40.9.A09.1.454.CMB.1.raw
  modified_base (302)..(302): a, c, t, g, unknown or other
  misc_feature (302)..(302): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtctttttcacacaaccaatgagaagaactactagctggtaccagcagagaccagacaacctcctaagtgctcttttacnggcgtcttcccgggagtccgggtccctgacgattcagtgccagcggtctggacagacttcactctcaccatcagcggcctgctaggctagagatggtacgctagtttactacgtgtcagctagttgtttggtccgttctccgttacgtttcgggacggtacgggtaccgtaagggtggacggtacgaaacggtactggtgcgtggacctacctagtcttaggtccttcgtacc

SEQ ID NO: 174492 - DNA, 511 bp, Homo sapiens
  misc_feature: GYAE6OF02F3VVX.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcgctgcaggctgaagatgtggctagtttattactgtcagcacttgtttggcggtttctccgtactttcggcggagggaccaaggtggaggtcaaacgactgtggctgcaccatctgtcttcattcccg

SEQ ID NO: 174493 - DNA, 521 bp, Homo sapiens
  misc_feature: GYAE6OF02FIQNC.40.9.A09.1.454.CMB.1.raw
  modified_base (402)..(402): a, c, t, g, unknown or other
  misc_feature (402)..(402): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaaagttgcttcttttactgggcgtcttcccgggagtccggggtccctgaccgattcagtgccagcgggtctgggacagacttcactctcaccatcagcgcctgcaggctgaagntgtggctagtttattactgtcagtcacttgtttggcggtttctccgtactttcgggcggtaggaccgaagggtggacggtacaaacggaactgtcggctgcacatctgtcttcattccc

SEQ ID NO: 174494 - DNA, 616 bp, Homo sapiens
  misc_feature: GYAE6OF02HN8GS.40.9.A09.1.454.CMB.1.raw
  modified_base (422)..(422): a, c, t, g, unknown or other
  misc_feature (422)..(422): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctcgtgggcgaggacgggccaccatctactgacaacgtccagccagtagttcttttcacacaaccaatgagaagaacttacttagcttaggtaccagcagagaccagacaacctctaagttgctctttactcggcgtccttccgggacgtccggggtcctagaccgtattcgagtcgccgaggccgggtcgtagggacagtacttcgactctccaacactcagccggcctgcacggctagaagntggtggacttaggttttattacgtgtctagcctacgttggttttcggccgggttttcctccggttacgttttccggggaacgggtacgggtaaaccgagggtgggtacggtaccgtaaacggtaacggttggtacgggtctacggtcccgtaaccgtacgttaccgttcgttaccctttcaaccgttttccccg

SEQ ID NO: 174495 - DNA, 529 bp, Homo sapiens
  misc_feature: GYAE6OF02FYC6J.40.9.A09.1.454.CMB.1.raw
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactacttagcttggtaccagcagagaccaggacaacctcctaagttcgcttcttttactgggtcgtcttcccgggagtcccggggtcctcgaccgattcagtgccagcggtcgtgggacagacttcactctcaccatcagcgctgcaggctgaagatggtgctagtttattactgtcagtctacgtttggtttcggtcgttcctccgtacgtttcgggcggaggtaccgagggtggacgtacgaaacgtntgtggctgccacngttcngttcttcattcccg

SEQ ID NO: 174496 - DNA, 582 bp, Homo sapiens
  misc_feature: GYAE6OF02G1OUP.40.9.A09.1.454.CMB.1.raw
  modified_base (268)..(268): a, c, t, g, unknown or other
  misc_feature (268)..(268): n is a, c, g, or t
  modified_base (421)..(421): a, c, t, g, unknown or other
  misc_feature (421)..(421): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtctttttcacacaaccaatgagaagaactacttagcttggtaccngcagagaccaggacaacctcctaagttgctcttttactggcgtcttcccgggagtccgggtccctgaccgattcagtcgccagcgggtctgggacagacttcactctcaccatcagccgctgcaggctagaagatggtggctagttttatacngtcagtcactttgttttcgggcgttttccgtaccgttacgttttcgggaccggtacgggtacccgtaagggttcgggaacggttacccgaaaacggttaaccgttgggtacgggtcccttaggaccctaaccgattacccgttcggttccgttactacccg

SEQ ID NO: 174497 - DNA, 524 bp, Homo sapiens
  misc_feature: GYAE6OF02HGGNC.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactggcgtcttcccgggagtcccgggtcctgaccgattcagtgccgagcgggtctgggacagactcactctcaccatcagccggctgcaggctgaagatgtggctagtttattactgtcagctagttgtttcggtcgttctccgtacgtttcgggcggtaggaccgaggtggaggtacgaaacggtacgtggtggcgttgcctacctagtctgtcttcattcccg

SEQ ID NO: 174498 - DNA, 563 bp, Homo sapiens
  misc_feature: GYAE6OF02G55RT.40.9.A09.1.454.CMB.1.raw
  modified_base (341)..(341): a, c, t, g, unknown or other
  misc_feature (341)..(341): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgcttctttactgggccgtcgttcccgggagtccggggtcctcgaccgtnttcagtgccagcgggtctggacagactcactctcaccatcagcgcctgcaggctagaagagtgtggactagttttatactgtcagtcacgttgtttcggcgtttcctaccgtacgtttcgggcgggtacggacgtaagggtggtacggtaccgaaacggtaacgttggaggtccgtacgtaccgaacccgtattccgttaggttcctttacgtacttccccg

SEQ ID NO: 174499 - DNA, 510 bp, Homo sapiens
  misc_feature: GYAE6OF02I2SZM.40.9.A09.1.454.CMB.1.raw
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtcttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcacatcagcgcctgcaggctgaagatggtggctagtttattacgtgtcagctattgtttggcgtttctccgtactttcgggcggacgggtcaaggtgggaggtacgaacgacgtggtgctgcaccntctgtctntc

SEQ ID NO: 174500 - DNA, 647 bp, Homo sapiens
  misc_feature: GYAE6OF02G43XA.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagactactagcttaggtaccagcagagaccaggactaacctcctaagttgcttctttacgtgggtccgtcgttcccgggtacggtcccggggtccctggaccgtattcgacgtcgccgaggtccgggtcgtcgggacaggtaccttctacctcctccaccatccgacggcccggcctgccgagggcctaggaagtgtggtcggacgttaagttttacgttacgtgttccgaagtcctacgtttgggtttcggtccggttccttacccggtacgtttccggggacgggtacgggtaaccgtaaggggtacggtacgggttaaccgaaaaccggttacgtagggtcgggtccctaggtaccctaaccggtagttcccgttaggtccctttacgtaccttcccccgg

SEQ ID NO: 174501 - DNA, 528 bp, Homo sapiens
  misc_feature: GYAE6OF02F4QFV.40.9.A09.1.454.CMB.1.raw
  modified_base (378)..(378): a, c, t, g, unknown or other
  misc_feature (378)..(378): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtctttttcacacaaccaatgagaagaactacttagcttggtaccagcagagaccaggacaacctcctaagttgctctttactggcgtcttccgggagtccgggtcctgaccgtattcagtgccaggcgggtctgggacagacttcactctcaccntcagcgctgcagctagaagatgtggctagtttactacgtgtcagtctacgttggttttcggccgtttctccgtacgtttcggcggtaggaccgagggtcggaggtacgaaacggtactggtggctggccaccgtattctgttcttcgtac

SEQ ID NO: 174502 - DNA, 585 bp, Homo sapiens
  misc_feature: GYAE6OF02ITNVT.40.9.A09.1.454.CMB.1.raw
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagtctagcgactcacgaccggtgctcgatttagcgagacgcgcagggggagcgtacaacaggcaggcaggggcagcaagatggtgttgcagacccaggtcttcatttctctgttgctctggatctctggtgcctacggggacatcgtgatgaaccagtctccagagtccctggctgtgtctctggcgagagggccaccatctactgcaagtccagacagtagttctttttcacacaaccaatagagaagaactacttagcttaggtaccagcagagaccagacaacctactaagttgtccttctttacgtggtccgtaccgttcccgggacgttcccgggtccgtcgaccgtattcagtcgaccaggcgggtcgtggacacgactcgactctacaccatcgagcgtctgcgagctagagntcgngtctagttttactacgtgacagtctagtttggtttacggccgtttccgtccgttacggtttccgggcggaaacgggtccgtaagggtcgaacgggtaccgaaaacggtcgttcggtcggtctacggaccgacctagttccgtcggttccttacctaccg

SEQ ID NO: 174503 - DNA, 711 bp, Homo sapiens
  misc_feature: GYAE6OF02H7AA8.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacgggggacatcgtgatgaaccagtctccagagtccctggctgtgtctcgtgggcgaggacgggccaccatctactgacaacgtccagccagagttcttttcacacaaccaatagagaaagaactacttagcttaggtaccagcagacgaccgaaggaaccaaccctacctaagttcgtcctactttttacgtcgggtccgttccgttcccgggtacggtcccgggtccctcggaccgtacttcagtcgcaggcggtcgtcgggacacgtaccgttcactcctaccacctactcgacggtccggcctgacgacgggtcctaaggaacggtacgttgggttacgggaccgtttaaggtttttacttaacgttcgttacgacggtaccttacggtttggttttcgggtccggttttacccgttcccggttacgttttccggggaccggggtacgggaaccgttaaggggtcgggtaacggttaccgtaaaacggtaacgttacgggtcggtaccgttacggacccgtccgtacgttcccgttacggtttcccgtttacccgttacgtttttaccccccgg

SEQ ID NO: 174504 - DNA, 523 bp, Homo sapiens
  misc_feature: GYAE6OF02FKJ9R.40.9.A09.1.454.CMB.1.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (518)..(518): a, c, t, g, unknown or other
  misc_feature (518)..(518): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcagtccagccagagtctttttcacacaaccaatgagaagaactacttagcttggtaccagcagagaccaggacaacctcctaagttgctcttttacngggcgtcttcccgggagtccgggtcctgaccgnttcagtgccagcgggtctgggacagacttcactctcaccatcagcgcctgcaggctagaagatgnggctagtttattactgtacngtccnttggtttggtcggtttctccgtacgttttcggcggtacgggacaagggtggacgtcaaacggtactgtggctgccactactcgttgtcttcnttccg

SEQ ID NO: 174505 - DNA, 633 bp, Homo sapiens
  misc_feature: GYAE6OF02JGASY.40.9.A09.1.454.CMB.1.raw
  modified_base (305)..(305): a, c, t, g, unknown or other
  misc_feature (305)..(305): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagacgtccctggctgtgtctcgtggcgagagggccaccgatctactgcaagtccagccagagtcttttcacacaaccaatgagaagaactacttagcttcggtaccagcagagaccaggacaacctctaagtgcttctttacgnggtacgtccttaccgggagtcccgggtcctcgtaccgcttacgacgtcgccgaggtacgggtctagggacgaagtacttaccgtactccgtctaaccgattaccgaagccgtacacgcgagccgtagaagacgtggtcgacttacgttttaattacgtagtcgaagtcgttacgttcggttttcggaccggttccttccggtaacgtttccggtcgggtacggaacccggtaggtcggtacggtaccgtaaaacggtcgtacggttacgggaccgttccgtaccggtaccgtacgttcgttaccgttacttacctagtttacccccgg

SEQ ID NO: 174506 - DNA, 637 bp, Homo sapiens
  misc_feature: GYAE6OF02FSDJW.40.9.A09.1.454.CMB.1.raw
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagttctttttcacacaaccaatgagaagaactacttagcttggtaccagcagagaccaggacaacctcctaagttgctctttactggcgtcttccgggagtccgggtccgtgaccgtatcagtgccagcgggtctgggacagtactcactctcaccatcaggccgcctgcgacggctgaacgtgtcggtggactaggttttattacgtcggtactagcgtaacttggttttagggtccgggttttcctaccccgggtttacgtttaccgggcggggttaaacgggaaccccgttaagggggttcgggaacggggttaacccgtaaaaccggggtaacctttagggggttaccggtaccgtacgggtaacctaccccgtaagttacccgttcggttacccttttacgttaaccccgg

SEQ ID NO: 174507 - DNA, 617 bp, Homo sapiens
  misc_feature: GYAE6OF02I90H7.40.9.A09.1.454.CMB.1.raw
  modified_base (336)..(336): a, c, t, g, unknown or other
  misc_feature (336)..(336): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactactagcttggtaccagcagagaccagacaacctcctaagttgcttctttactggcgtcgttcccgggagtccgggtcctgaccgtnttcagtcgccagcgggtctcgggacacggtacttccacttcctcaccactccgagcccggcctgccgaggtcctagaagtagtgtaggtacttaagtttacttacgtagtccgagtccgtacgtttggttttacgggccggtttacctccggttaaccgttttccgggacgggtacgggtaaccgacgggttgggacggttaaccgaaacgggtaacttcgggtacggtacgttacgaccgtaaccgtcttacccgtgtttacctacgttaccttccccgg

SEQ ID NO: 174508 - DNA, 636 bp, Homo sapiens
  misc_feature: GYAE6OF02HRGOV.40.9.A09.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtcttttcacacaaccaatgagaagaactactagcttaggtaccagcagagaccagaacaacctctaagttgcttcttttacgnggccgttcgttcccgggacgttcccgggtccctgaccgtatcgagtcgccaggccgggtntgggacagtacttcactctcacctntcgagtcggcctgcaggcctaggaagtagtggtacgcgttaagttttaactaccgttgtaccgacgtcgttacgtttcggttttcgggtccggtttccttacccggtacgttttccggggacggtaacgggtaaccggtaagggtcgggtaacggtttaccgaaaaaccgggttaccttaggggtaccgggtacccgttggacccgtacccgtaaagttccggttacttaccgtttctaacccgg

SEQ ID NO: 174509 - DNA, 590 bp, Homo sapiens
  misc_feature: GYAE6OF02HCKI4.40.9.A09.1.454.CMB.1.raw
  modified_base (243)..(243): a, c, t, g, unknown or other
  misc_feature (243)..(243): n is a, c, g, or t
  modified_base (575)..(575): a, c, t, g, unknown or other
  misc_feature (575)..(575): n is a, c, g, or t
  modified_base (584)..(584): a, c, t, g, unknown or other
  misc_feature (584)..(584): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagtcttttcacacaaccatganaagaactactagctgtacagcagagacagacacctacctaagtgcttctttacgtggcgtcgtccggtgtccgggtcctgccgtgtcgagtcgccaggcggtcgtggacacgtacttcactctcacctatcgacgcgcgtcgcgaggctaggaacgtgtgtaggacgttaggttttactaaccgtcgtactacgcttacgtttaggtttcggtccgtttcgtaccgttacggtttccgggacggtaacgggtaccgtaacggggtggtaccggttaaccggaaaccggtaacgttgggtaccgtcgtacgccgtacccgtattaccggtttnttacccgtnttaccg

SEQ ID NO: 174510 - DNA, 590 bp, Homo sapiens
  misc_feature: GYAE6OF02G2AUA.40.9.A09.1.454.CMB.1.raw
  modified_base (409)..(409): a, c, t, g, unknown or other
  misc_feature (409)..(409): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagttcttttcacacaaccaatgagaagaactacttagcttggtaccagcagagaccaggacaacctcctaagttcgctctttacgtgggtcgtcgttcccgggagtcccggggtccctgaccgtattcgagtcgccaggcgggtctgggacagtacttcactctcaccatcacgccgcctgcgacggntaggaagatggtcggactagtttacttacgtgtacagccttagttcggttttaggccggttccttaccggttacgtttccgggacggtacggggacccgtaagggacgggtacggtaacgaaacggtaacgttgggtacggcgttacgccgtacctagtccgttacggttctacttacccg

SEQ ID NO: 174511 - DNA, 599 bp, Homo sapiens
  misc_feature: GYAE6OF02GAYZB.40.9.A09.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactacttagcttgtaccagcagagaccaggacaacctcctaagtgcttctttacgnggtcgtcgttcccgggagtcccgggtcctgaccgtattcagtnccagcggtctggacagactcnctctcaccatcagccgctgcgagctagaagntggngtatagtttagtacgtgactagtacctagtttggtttcggtcggtttcctccggttacgtttccgggacgggtacggtaaccgtaagggttcgggtaccggttaacgaaaacccgggttacgtagggttcgggtaccgttacggaccctaaccgtacgtttaccgtagtttaccccttacgtacccgtttcccccgg

SEQ ID NO: 174512 - DNA, 682 bp, Homo sapiens
  misc_feature: GYAE6OF02HZ51Q.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctcgtgggcgaggagggccaccatctactgcaagtccacgccagtagttcttttcaacacaaccaatagaagaagaacttacttagcttggtaccagcagagaccaggacaacctactagttcgctcgtttacgtcggtcgtccgttcccgggtacggtcccgggtccctgtaccgtcttcgagtcgccgacgggtcggtcgtacggtacacggtacttacgtactcctacgtaacctacgttccgaacggtcccggaccctgaccgacgggtctagggaaacgtgttacggtcgggtactttaacggttttattccttacggtcgaacgccgtttacggttggttttacgggttcccggtttaccgttcccggttacggtttccggggtaccggggtacgggtaacccgtaggggtacgggacgttaaccggaaacggtcgttagggtcggtacgttacggcctaccgtcgttaccgttcgttacttaccgaccgtttccccg

SEQ ID NO: 174513 - DNA, 691 bp, Homo sapiens
  misc_feature: GYAE6OF02I0DO7.40.9.A09.1.454.CMB.1.raw
tcagtctagcgactcacgaccggtgctcgatttagcgagacgcgcaggggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacaccaaaccaatgaagaagaactaactagtcttacggtaccagacagacgaccaggaacaacctacctagttcgccttacttttacgtgggtccgtccgttcccgggtacggtcccggggtccctcggaccgtacgttctagtcgaccgacggtcgggtcgtgggacagtactcactcctacacctatcgacgccggctcgcgacggtctaggaagtgtggtaggtaccttaagttttacttaccgttggtaccgtacgtacgttacgtttagggttttcgggtacccggttttccgtacccgggtttaccggtttccggggacggggtaacgggtaaacccggttaaggggtacggggtaccggtaacggtaaaaaccggttcggttacgggtacgggtaaccgtcggtaccctaaccgtacttccggttgtttacccgtttacgtaccctttccccgg

SEQ ID NO: 174514 - DNA, 544 bp, Homo sapiens
  misc_feature: GYAE6OF02GEP2B.40.9.A09.1.454.CMB.1.raw
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactacttagcttggtaccagcagagaccaggaccaaccgtcctaagttgctcttttacgtgggcgtccttcccgggaggttcccggggttcccgtcgtaccgacttcgagtgccagcggtcgtgggacagacttcactcgtcaccatcagccgctgcnggctgaanatgnggctagtttatactgtcagctacttggtttgcggttcctcggttacgtttcgggcggtacggtacaaggggtggaggtcaaacggtaactggcggtctgaccnctatcgtgtccgttntcgttcccg

SEQ ID NO: 174515 - DNA, 647 bp, Homo sapiens
  misc_feature: GYAE6OF02JDLOR.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagacgaccaggaccaacctcctaagttcgcttcttttacgtgggtcgttcttcccggggagttcccggggtcctgaccgattcagtgccaggcgggtctgggacagtaccttcaccttcctcacctacgtccacggccggtccctggcccgagggacctaggaacgtagtcggtagggtcttaaggttttaacttacgtgtaccaggtcctacgttgtttcggtccggtttcttcccggtagttttccgggacggtacggggaccctaaggggttcgtagggtaacccgtaaaccgggtactttagggtaccgggtacttaccggcccgtaaaccctaggtttccgttacggtttccctttaccgttaacgtttcccccg

SEQ ID NO: 174516 - DNA, 709 bp, Homo sapiens
  misc_feature: GYAE6OF02J2NCU.40.9.A09.1.454.CMB.1.raw
  modified_base (664)..(664): a, c, t, g, unknown or other
  misc_feature (664)..(664): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgacaacgtccagccagagtcttttcacacaaccaatcgaagaagaactactagcttacggtaccagcagacgacacggacctaacctactaagttgtaccttcgttttacgtcgggtccgtccgttcccgggtacggtcccggggttccctacggtacccgtacgttcaacggtccgtccgaacgggtccgggtaccgtacgggacgtacggtacttcgacctccgtaccaccgcgtacgacggtccggacccgttggaccgtacgggtctacgggtaaacggtacgtacgggttaggtaccgttaacggtttttaaccgtttaacgtcggttaaccgaacggttccgttaacgttttcggggttttaccggtccggttttaccgttcccggttaaccggtttcggggacgggtacgggtaaccgtagggtcgtacggtaccgtaacgtacggttcgngtacccgtgaccttacgacgtcttcgtacccttcgtacgttcccg

SEQ ID NO: 174517 - DNA, 672 bp, Homo sapiens
  misc_feature: GYAE6OF02JC5ZX.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgaagaagaacctacttagtcttaggtaccagcaagagaccaggaccaacccttacctaagttgccttacttttacgtgggtccgtccgttcccggggacggtcccggggtccctacggtaccgtacttacgacgtgaccgaggccgggtctcggggaactacggactttcgaccttcctaccaacctatccgacggcccggtccttcggaccgtaagggcgttaggaacgtacgtggtcggtaccgttaaggttttactttacttcgttcgacgtccgtacgttttggttttacggccggtttccgtccggttaaccgttttccgggacgggtaacgggtaaccgtaagggtagggtacggtacgaaaccgtacgtggtcgggcttacgaaccgtaccgtacgttctacggttccttactacccgtttcccg

SEQ ID NO: 174518 - DNA, 703 bp, Homo sapiens
  misc_feature: GYAE6OF02HOAH1.40.9.A09.1.454.CMB.1.raw
  modified_base (466)..(466): a, c, t, g, unknown or other
  misc_feature (466)..(466): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctcgtgggcggaggagggccaccatactactcgcaagtccagccagtacgttcttttcacacaaccaatgagaagaactacttagcttgtaaccagcgagagaccgaaggactaaccctcctaagttgccttacgttttacgtcgggtccgttccgttcccggggacggttcccggggttcccgtcggtacccgtacgtttccgtacggtcggccgtaggccgggtcgtgggaacgtcggtacttcctacctcctaccacctacgtccgacggccggtcctgacccgngggtaccttaggaaaggtctacgggtcgtcgttaaggtttttacttaacgttccggtagtaccgaacgttcgttttacgggttttcgggttcggtttccccgtacggtttaaccggtttcgggggacccggggtacggtaaccggtaaggggttcgggacgggttaaccgaaacggtacgtcgggtacggtacgtccgtacctacgtattaccgttcgtccgttcacgtttcccccg

SEQ ID NO: 174519 - DNA, 749 bp, Homo sapiens
  misc_feature: GYAE6OF02GOWAS.40.9.A09.1.454.CMB.1.raw
  modified_base (249)..(249): a, c, t, g, unknown or other
  misc_feature (249)..(249): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgcaagtccagacagagttcttttcacacaaccaatgagaanaactacttagcttggtaccagcagagaccaggacaacctacctaagtgcttacttttacgtgggccgttccgttcccggggacgttcccggggtccctacggaccgtacgttcaggtcgccgaggccggggttctgggaccagtaccttcactcctccacctacgtaccacggccggtaccctggaccgtagggtaccttagggaaacgtacggttcgggtacgggttaccgttaaggttttttaactttaccgttacggttaccgtaaggttcccgttaaggttttccgggtttttacgggggtaccccggtttttaccggtaccccgggtttaaccggtttttcccggggaccgggggttaaaccggggtaacccggtaaggggttcggggtaacgggttacccggaaaaaccgggttaacggttcgggtaccgggtacccttagggtacccctaaccgtacggttacccgttccggtttacccgttccgttaacccg

SEQ ID NO: 174520 - DNA, 872 bp, Homo sapiens
  misc_feature: GYAE6OF02IYM1D.40.9.A09.1.454.CMB.1.raw
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccacatctactgcaacgtaccagaccagagttcttttcaaccacaaaccaatagagaaagtaactacttaagctttaggtaccagtcaagagaccagacaacctcctaagtgcttactttacgtgggcgttccgttcccggggagttccccggggtcctacggtaccgactttacgacggttcgacccgtaaggtccggggttctaccgggggactaaacgggtacctttaccgaaaccgtttcccgtacccgaaaccctaagttcccgggaaacggtcccgggtaacccctttcggaccgtaaaccgggtccggtaaggttaaaacggaactttcggggtcggttaacccgtaagggttttttttaaacctaccgtttacgtttacccggaaaccgttccgttaaaccgtttttcggggttttttaaccgggtccgggttttacccggtttaccccggtttaaaccgggttttttcccggggggaaccggtaacggggggttaaaaccccgttaaaggggggttaccggggttaaaccgggtttaaaaccccgggaaaacccggttaaacggttttaccgggggttacccggggacccgtttaaccgggtaaccccgggtaaaccctttacggtaaccccggtttttggtttaccccgtttacgtttaacccccgg

SEQ ID NO: 174521 - DNA, 565 bp, Homo sapiens
  misc_feature: GYAE6OF02GVABL.40.9.A09.1.454.CMB.1.raw
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagacagagttcttttcacacaaccaatgaagaagaactacttagcttggtaccagcagagaccaggacaacctcctaagttcgctctttacgngggtctccgttcccggggagtcccgggtcctgaccgtnttcgagtcgccaggcgggtcgtgggacagtacttcactctcaccatcagccgctgacgngctgaagngtgtgactagtttatcgtgtcagctagttggtttggcgttcgtccgtacgtttcgggacggtaacggaccgtaagggtcgtacggtacgtaaaccggtaacgttggacggtccgtacgactaaccgtcgttccgttacgttccttgttaccc

SEQ ID NO: 174522 - DNA, 827 bp, Homo sapiens
  misc_feature: GYAE6OF02GFS5I.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgccgtacggggacatcgtgatgaaccagtctccagcgtccctggctgtgtctcgtgggcgaggacgggccaccatctacgtgacaacgtccacgaccagtacgtttccttttacaacctaaccaaaccaagtagaaagaaacgtaaaccttaacgttaacgtcgtttacggtaaccagacaaggaacgaacccgaaggtaaccctaaacccgttaccgttaacggttcgtacccttttccgttttaccggtcggggtacccgtttacccggttccccgggggtaccggttcccccggggttaccccttacggtaacccgttacttaccggacggtccgaccggtacgggtccggggttacgtacggggtaacctacgtaccttccgtacttccgtaccacccgtacgtccgaccgggtcccggtaccgtacggccgacggttcgtaacgggaagtcgttcgggtacggtactttaacggtttaacttaccgggttagtaccgtaggttaccgtttacgggttttcgggttttaccggggttcccgtttaccgttacccgggttacggtttaccggggaccgggtaacggtaaccgggtaggggttacgggtaacggtaaccgtaaaccggtgttcgggacgccgttacggtacctacggtttccgtccgttaccgtttaccttacgtcccgttacccg

SEQ ID NO: 174523 - DNA, 645 bp, Homo sapiens
  misc_feature: GYAE6OF02GEI0N.40.9.A09.1.454.CMB.1.raw
  modified_base (301)..(301): a, c, t, g, unknown or other
  misc_feature (301)..(301): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtcgtctcgtgggcgagacgggccacgatctactgcaagtccagccagagttcttttcacacaaccaatgagaagaactactagtctggtaccagcgagacgaccgaggacaacctacctaagttcncttactttacgtgggtcgttcccgttccgggacggttccgggtccctggaccgtattcgagtcgccgtacggcggtcgtgggaacngacttcgactcncacctatcgacgccggtacctgacaacgtactacggaagtaacttgggccggtattaacgttttattaaccgtgtcaacgtctacgttttaggttttcggccgtttacctcccggttaacgttttccgggaacggtagggtaacccgaaggggtttagggaccggttaacgtaaacgggtaaccggtgttaccgggccttagccccggtaattaccgtccgttagttaccttacacgtttcccccg

SEQ ID NO: 174524 - DNA, 712 bp, Homo sapiens
  misc_feature: GYAE6OF02JOGW0.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgccgtacggggacatcgtgatcgaaccagtctccagtacgtccctggctgtcgtctcgtgggcgaggagggccaccactctactgacagtccagcagtagttcttttcacacaaccatagagaacgaactagtacgtacgttacgtaccagacagacgacacggaccaacctacgtaacgttcgacttacgtttacgtcgggtaccgttccgtaccgggtacggttccgggtcccgtacggtaccgttacgttcgacggtacgtaccggtacggtccgggtcgtacgggtacgacggtacttacaccgttccgtacctaccgtactacgtacggccgtacccttacggcgtacgtcgtagaaggtacgtggtcgtacggtttagtttacgttcgtagtacgtacgtacttcggtttacgggtttccgtaccggtttaccgttacccggtttaacggtttccggggaagggtaacccgggtaacggtagggttaccgggtaacgttaaccgtaaccgggtaacggttcggtacggtacgtccgtaccgtacgtacgtcgtttacggtcttactcgtttaccccg

SEQ ID NO: 174525 - DNA, 632 bp, Homo sapiens
  misc_feature: GYAE6OF02HV39B.40.9.A09.1.454.CMB.1.raw
  modified_base (393)..(393): a, c, t, g, unknown or other
  misc_feature (393)..(393): n is a, c, g, or t
  modified_base (430)..(430): a, c, t, g, unknown or other
  misc_feature (430)..(430): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgagagggccaccgatctactgcaacgtccagccagagttcttttcacacaaccaatgagaagaactactagcttggtaccagacagagaccaggaaccaacctacctaagttgcttctttacgtcggtctccgttccggacgtccgggtcctgaccgtattcgacgtcgcaggcggtcgtaggacaggtctcgactcgtcacctnacgtacgcggtcctaggcagggtacttagggaaagtntcggtacgggtaccttaaggtttttataaccgtggtacagtccttacgtttgggttttacgggccgtttcccttccgggtaccgtttcgggaccgggaaagggtacctaaggggtcgggtaacgtaccggtaaaccggtacgttggtcgggtaccttacggacctacgtacgtcgttacgtttacctaccgtacttccccgg

SEQ ID NO: 174526 - DNA, 555 bp, Homo sapiens
  misc_feature: GYAE6OF02F9USD.40.9.A09.1.454.CMB.1.raw
  modified_base (304)..(304): a, c, t, g, unknown or other
  misc_feature (304)..(304): n is a, c, g, or t
  modified_base (475)..(475): a, c, t, g, unknown or other
  misc_feature (475)..(475): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgaagaagaactacttagcttggtaccagcagagaccaggacaacctcctaagtgctcttttacnggtcgtcttccgggagtcccgggtcctgaccgtattcgagtgcctaggcgggtctgggacagtacttcactctcaccatcgagcggcctgcaggcagaagatggtggacttagttttactactgtcacgtcacgtttgttttgggccggtttccgtccgtagtttccgggngaacgggtactagggtcgaggtaccaaacggtacgtgtaggcctggaccaccgtattccgtgttcttactacgttccccg

SEQ ID NO: 174527 - DNA, 616 bp, Homo sapiens
  misc_feature: GYAE6OF02HDYT1.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagacgtccctggctgtgtctctgggcgaggacgggccaccatctactgacaacgtccagccagtacgttcttttacacacaaccaatagagaagaactacttagcttaggaccagcagagaccaggacaacctcctaagtgcttctttacgtcggtcgttcgttcccgggacggtccgggtcctcgaccgtatcgacgtcgccaggtcgggtcgtcgggacacgtactcactcacacatcgagcgccctgcgagtcgtagaagtgtgcggtacttaagttttactacgtgactacgtcttacgttggtttcgggccgtttaccgtccggttacgtttccggggacggtaacggtaccgtaagggtacgggacgtaccgtaaaacggtcgttcgggtacggtcgtaccgactaaccgtagttccgttaccgtttaccgttacgaccctttacccgg

SEQ ID NO: 174528 - DNA, 630 bp, Homo sapiens
  misc_feature: GYAE6OF02GTY6R.40.9.A09.1.454.CMB.1.raw
  modified_base (602)..(602): a, c, t, g, unknown or other
  misc_feature (602)..(602): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgacaacgtccagccagtacgttcttttcacaccaaccaatagagaagaactactagcttggtaccagcagacgacagacaacctcctaagttcgcttctttacgtcgggtccgttccgttaccgggtacggtcccggggtccctcggacccgtattcgacgtcggccgagggcgggtcgtacgggacgacgtacttcactctcgacccatccgaggccggtctcgcgagggctaggaagagttggtcggtaccttaggtttacttacgttcgtaccgagtccttacgtttgggtttcgggtccgtttcgttccggtacgtttcggggaccgggtacggaaccgtaaggggtcgggtaacgtaccgaaacggtgtggtacggcctgtacccaccgtnttaccgtcgtttccttcgtacttccccg

SEQ ID NO: 174529 - DNA, 752 bp, Homo sapiens
  misc_feature: GYAE6OF02FRTZ5.40.9.A09.1.454.CMB.1.raw
tcagtctagcgactcacgaccggtgctcgatttagcgagacgcgcagggggctacaacaggcaggcaggggcagcaaagatggtgttgcagacccaggtcttcatttctctgttgctctggatctctggtgccgtacggggacatcggtgagtgaaccagtcctccagacgtccctggctgtgtcctcgtgggcgaggacgggaccacgatctactcgacaacgtccacgacctagtacgtttcctttttaccaaccaaccaaaacctaacgttagaaacgaacgtaaaccttacgttacgtcgttacgtaccagacagaacgaccacggaacctaacccttaccgtaagttgtccttacgtttacggtcgggtccgttccggtcccgggtcggttcccggggtccctggtacccgtacgttcgacggttcgaccggtagggccggggttacgtcggggactaacggtactttaccgaccttccgtaccaactacgtaccgaccggtccggtcccgtggaccgagggtctaaggaacgtaggttggtacgggttaacttaggtttaacttacgttagtcctacgttaccgtagtttcgggttcgggtccgttttaccgtccggtttacggttcgggtaccggacgggttaaccgtaggggtaccgggtacgtaaccgaacgtacgggttcggtcgggtccgttacgacgtaaccgttacttccggttacgtcctttaccgtaccttacccgg

SEQ ID NO: 174530 - DNA, 853 bp, Homo sapiens
  misc_feature: GYAE6OF02HCLNZ.40.9.A09.1.454.CMB.1.raw
tcagtctagcgactcacgaccggtgctcgatttagcgagacgcgcagggggctacaacaggcaggcaggggcagcaagatggtgttgcagacccaggtcttcatttctctgttgctctggatctctggtgccgtacggggacatcgtgatgaaccagtctccagacgtcccgtggctggtcgtctcgtgggcgagacggccacatctactgacaacgtccagccagtagttcttttaccacaacctaaaccaatagaacgaaagaacttaacgttaggtcttacggtaacccagtacgaagacgaccgaacggaacctaacccgttaccgttaaacgtttcgtacctttcgtttttaaccggtcgggttaccggttcccggtttaccccggggttaacgggttcccccggggttccccgttaccggaacccgtacgttaccggtaacggttccggacccggaaggggttccggggttaccggtttacggggaaccgtacggtttaaacccgttcccgtacttcccctacctaaaccggtacgttaccgaaccgggtcccgggtacccgtcgggcgtaccgggtacgttaacggaaaggttacggttacgtgggtaccgttttaacgggttttacgtttaccggcgttaacgtacgtaccgtttacgtttggttttaccggggtcttttacccgggttaccggtttaccgggtttacggggacgggtaccgggtaacccgggttaaggggtaccggttaacgggtaaccgtaaacgggttaccgtgggttccggtacggtaccgaaccgttaacttcggtacgttccgttaacgttacctaccgtttcccccgg

SEQ ID NO: 174531 - DNA, 702 bp, Homo sapiens
  misc_feature: GYAE6OF02GCDR7.40.9.A09.1.454.CMB.1.raw
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
  modified_base (433)..(433): a, c, t, g, unknown or other
  misc_feature (433)..(433): n is a, c, g, or t
tcagtctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgaggacgggccaccatctactgcgaacgtccagccagacgttcttttcacacaaccatganaagaactactagcttcggtaccagcagacgaccgtaggaccaacctcctaagtgtaccttacttttacgnggtaccgttccgtccggggtacgtcccggggtccctcggtaccgtcttccgacgtcgtccgacggtccgggtacggtcgggacgtacggacctttacgaccgttcctacgtaaccncgttaccgaccgggtccggtacctcggaccggaggtcccgtaaggtaacgtaagttcgggtaggtaccgtttaagttttacgttaaccgttcggttaacgacgtaccgtacgttttcgggtttacgggttccgttaccgttccgttaaccgggtttccgggacgggtaccgggtaaccgtaggggttacgggacgttaaccggaaccggttaacgtggtcggtacgtacggacctacgcgtttacgctttaccttacgccctttacccg

SEQ ID NO: 174532 - DNA, 838 bp, Homo sapiens
  misc_feature: GYAE6OF02FJ71F.40.9.A09.1.454.CMB.1.raw
  modified_base (181)..(181): a, c, t, g, unknown or other
  misc_feature (181)..(181): n is a, c, g, or t
  modified_base (629)..(629): a, c, t, g, unknown or other
  misc_feature (629)..(629): n is a, c, g, or t
tcagtctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatcgaaccagtctccagacgtccctggctgtntctcgtggcgaggacgggccacctagtctacgtgacagtccacgccgaagtacgtttcctttttacacctacaaacaaatagaacgaagtaaccttacttagcctttacggtaacctacgactaacggacgaacccgtaagggtaacccaaaccccgttaccgtaacgtttacgtaccctttaccgtttttaccggtacggggtttcccgtacccggtttccccggggtaacggggttcccccgggggtccccttacggacccggttacttacggtaagtccgccgacgggtaccggggttcgttacgggaaccgtaggtaccctttacctacgttccctacgtaacccgtcttacggcccggcccggttcccgacggtcggtaccgggccttaaggaaacgtcggtttcgggttacggtacgttttaaggttttaccgtttaccggngtttaaccgcggttacctttaaccggtttggttttaccggggtcccgttttaacccgttcccggtttaaggggtttccgggacccgggttaaaccggggttacgaacgggggttttacgggaaccggttaaccgaaaccggttacggttcggggtaccgtaacgtcgacccgtacgttaactccgtttacggtcctttacgtaccccgg

SEQ ID NO: 174533 - DNA, 541 bp, Homo sapiens
  misc_feature: GYAE6OF01BRKV8.22.15.B04.1.454.CMB.1.raw
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaacccccaactcatcatttatgtgtcactcgtcgccctcaggagtctctcatcgcttctcagctccaagtctggcaacacggcctccctaaccactctctcggctcctagtttgaggtacgagtctacttattactgactagttacctttaaagtacgtcgtacctactcgttcgttggttttcggacggtacggccgaccgtagtcgtaccgtccgtcgtcacgtcccgaagcctacgccccctcgtccactcctcgtccccc

SEQ ID NO: 174534 - DNA, 501 bp, Homo sapiens
  misc_feature: GYAE6OF01CLAEH.22.15.B04.1.454.CMB.1.raw
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggnggttataactatgtctcctggtaccaacaacacccaggcaaagccccaaatcatgatttangagtcactaagcggcctcagggtccctgatcgcttctctggctccaagtctggcaacacggcctcctgaccgtctctgggctccgaggctgaggatgaggctgattattactgcagctcatagtggagcagcgataagtttggtgttcgggcggaggaccagcgtgaccgtctaggcagccgaaggctcgcccctggtcacg

SEQ ID NO: 174535 - DNA, 540 bp, Homo sapiens
  misc_feature: GYAE6OF01BS3NQ.22.15.B04.1.454.CMB.1.raw
  modified_base (361)..(361): a, c, t, g, unknown or other
  misc_feature (361)..(361): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcgaggggtccctgatcgcttctctggctcaagtctgcaacncgcctccctgacccgtctcgtcgggcctccgaggcctggaggatggaggtctaggatttacttacgtgcagtctacatagtggagcagcgactaagtttggtgttcgggcggagggaccaaggcgtcggacccgtcgtaggtccacggcccgaaggcctcggcccccttggtcctaccg

SEQ ID NO: 174536 - DNA, 509 bp, Homo sapiens
  misc_feature: GYAE6OF01CMP9N.22.15.B04.1.454.CMB.1.raw
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttangaggtcactaagcgggcctcgaggggtccctgatcgcttcnctggctccaagtctggcgacacggcctccctgacccgtctctggctccaggctgagatgaggctgattatactgctactcatatgcaggcggcaactcgttgggtgttcggcggaggaccaagctgaccgtccgtaggtcagcccaaggctagccccctggtctaccg

SEQ ID NO: 174537 - DNA, 904 bp, Homo sapiens
  misc_feature: GYAE6OF01E3LHD.22.15.B04.1.454.CMB.1.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagacatacgcgtcacgaccggtgctcgatttagacagtatatataccggacggggggggtctcaggaggcagcgctcctcacggacgtctaccaccgtattggccttgggctctgctcctcctacagcctcctacactcagggcacgtaggggtcctgggcccagttcgtcgtccccttgactcgtacgttacccgtccctccgcggtccgggtctccgtggacagtcagtcaccagtctcctgccacgtgggaaccngcagtcgtacgttgtgtanaactntgtctcctgtaaccctaacaaccaccaggcaaacgcccccaaagtcagtcgactttagcggacgggtacgacgtaaggcccgggtcccttacgacggggttaccctaggtaactccgtacttacgtacgttcgggacctaccgaaagttccttaggacctaaaccgtaccgggtcccctttaccccgtagggaaccccggtttccgttacccggtacggggtacccttaccccggtaacgggtaccgttacgggtaaacgggttaacgtttacgggaacggggtccgttaaggttaaccgttttaacgtttaccgttaacggtacccgtaaacggtaccctttaacgtaaacgttaacgggtcgggtaaacgggaccgaaacggggtacccggtaaaaccgttaaacgggtttttacgggggttaccgggttttaaccgggggtaccgggtttaaacccgggggtaaacccgttaaacgggtaaccccggtttaacgggttaacccccggtttaccggttaaacggggttacccgtaacccgggtaccccccggtaaaacccggggttccccttaccccgggttaccccccccggttacgggtttccccgttaaacccgg

SEQ ID NO: 174538 - DNA, 548 bp, Homo sapiens
  misc_feature: GYAE6OF01ENHV3.22.15.B04.1.454.CMB.1.raw
  modified_base (306)..(306): a, c, t, g, unknown or other
  misc_feature (306)..(306): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaacgcccccaaactcatgatttangaggtcacgtaagcgccctcgacggggtccctgactcgcttctcgtggcctaccaagtctggcaacgacggccctcccgtgacccgttctcgtcgggcctccgaggctaggaggatggaggctgtattattactgcagtctcaatagtggagcaggcgaatagtttgggtggttcgggcggacgggaccaaggcgtacgccgtcgtaggaccgacgacccgaaggcctccggccccgtacgg

SEQ ID NO: 174539 - DNA, 514 bp, Homo sapiens
  misc_feature: GYAE6OF01B68QK.22.15.B04.1.454.CMB.1.raw
  modified_base (303)..(303): a, c, t, g, unknown or other
  misc_feature (303)..(303): n is a, c, g, or t
  modified_base (453)..(453): a, c, t, g, unknown or other
  misc_feature (453)..(453): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggacaaacgcccccaaatcatgatttangagtcactaagcgccctcgacgggtcctgatcgcttctctggctcaagtccgcaacgacgcctcctcgaccgtctcgtgggctccgaggctgaggatggagtctgatttatactgacagctcatagtggaggcagcgtaataagtttggngttcgggagacgggaccaagcgttagaccgtcaggtcacgccaaggctcgccccgtgtccc

SEQ ID NO: 174540 - DNA, 664 bp, Homo sapiens
  misc_feature: GYAE6OF01B9XS0.22.15.B04.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccagcagtgacgttggtgttataactntgtctcctggtaccaacaacaccaggcaaacgccccaaatcatgatttangagtcactaagcgcctgacgggtcctgactcgcttcnctgctcaagtctggacaacgcggcctccgngtaccgtctcgtcgggcctaccgaggtcctggaggtagtggacggtcttaggtaactttaacgttacgtcgaccgtaggtcctataagttacggtacgggaacggccgtaaggtaccgtaaacgtttaaaggttttcggggttacggtttacccgggggacgggtaaccggggtaacccgtaaaggtccccggtacggtaaccccggttacccggttaacgggtacccgtaacccgggtaccccgtaaacgggccccgttaccccgggtcccccccgttagggttaccccttaccccgg

SEQ ID NO: 174541 - DNA, 565 bp, Homo sapiens
  misc_feature: GYAE6OF01B5VPM.22.15.B04.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactntgtctcctggtaccaacaacacccaggcaaagcccccaaatcatgatttangaggtcactaagcggccctcgacggggtccctgatcgcttctctggctcagtcnggcaacncggccctcctgacccgtctcgtcgggcctccgaggctgaggtatggaggtctgatttagtactgcagctcattagtgggaggcaggccgtaacgttaagtttcgggtggttccgggcgggtacgggtaccaaggtccgtacggtacccgttccgtagggtccacggccccgtaaggcctaccggccccccttgggtcctacccg

SEQ ID NO: 174542 - DNA, 537 bp, Homo sapiens
  misc_feature: GYAE6OF01CYHA2.22.15.B04.1.454.CMB.1.raw
  modified_base (300)..(300): a, c, t, g, unknown or other
  misc_feature (300)..(300): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacacccaggcaaacgccccaaactcatgatttangagtcactaagcggccctgacggggtccctgactcgcttctctggctccagtctggcaacacggcctcctgacccgtctctcgggcctcccgaggctggaggatgacggctgtatttattacgtgcagtctcatagtggacggcagcgacttaagtttgggtgttcgggcgggaggaccagcgtcggaccgttcgtacggtcacggcccaacggctcccggccccctggtcctaccg

SEQ ID NO: 174543 - DNA, 681 bp, Homo sapiens
  misc_feature: GYAE6OF01BANEC.22.15.B04.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactntgtctctgtaccaacaacaccagcaacgccccaaatcatgtattangagtcactaagcgcctcgacgggtccctgactcgcttctcgtgctcgagtctcggacaacgaccgccctcccgtcgacccgtctcgtcgggcctccgaggtcctaggacggtagtacggacggtcgttagtaactttaacgttaccgtcgacctagtaccttacgtaagttaggtacgggacgggtacgaacggtaccgttaaacgttaaggtttttcggggtacgggtttaccggggaacggggtaacggggtaacccgtaaacgggtccgttaaccgggtaaccccggttacccggttaacggggtacccgtaacccggtaccccggtaaacgggtccccgttaccccgggccccccccggtttacgggtcccctaaaccccgg

SEQ ID NO: 174544 - DNA, 574 bp, Homo sapiens
  misc_feature: GYAE6OF01ATY5A.22.15.B04.1.454.CMB.1.raw
  modified_base (301)..(301): a, c, t, g, unknown or other
  misc_feature (301)..(301): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggacaaacgccccaaactcatgtatttangagtcacgtaagccggccctcgacgggtccctgactcgcttctctggcctcagtctcggcaacgccggtccctcccgtgacccgtctcgtcgggctccgaggtctggaggntggaggtctagtatttattacgngcagctcatgtggacgcaggtccgtaattagtttgggtcgttcgggacgggtacggaccgaaggtccgtacgtacccggttacgtacggccgaccgtacccgaacgggtccctacccggtcccccgtggtccctacccg

SEQ ID NO: 174545 - DNA, 551 bp, Homo sapiens
  misc_feature: GYAE6OF01BNYFF.22.15.B04.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaatcatgatttangaggtcactaagcgccctcgaggggtccctgatcgcttctctggctccaagtctggcaacncggcctccctgaccgtctctgggcctccgaggctgaggatgaggctgtattattactgcagctcatagtggaggtcagcgactaagtttggtggttccggcgggaacgggaccaaggtcgtacggtacccggtccgtagggttcccacggtacccccaaagggtccctccggccccccgttacggg

SEQ ID NO: 174546 - DNA, 605 bp, Homo sapiens
  misc_feature: GYAE6OF01EBF3P.22.15.B04.1.454.CMB.1.raw
  modified_base (367)..(367): a, c, t, g, unknown or other
  misc_feature (367)..(367): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacaccaggacaaacgcccccaaatcatgatttatgaggtcactaagcggccctcgacggggtccctgactcgcttctctggctcaagtctggcaacnccggccctcccgtgacccgttctcgtcgggtccttccgtagtttggacggtacgtagttcttaaccttatttactgtaccttagtttacctttaaagttcggccgtcctacgttcttcggttcgggttttccggcggtaggccgtaccggtagtcgtacccgttccgtccggtcgacgcccgaacggcctccgcccccgttcggtcctaccgtccgttccgttcccccgcccgtcccg

SEQ ID NO: 174547 - DNA, 545 bp, Homo sapiens
  misc_feature: GYAE6OF01DL8TU.22.15.B04.1.454.CMB.1.raw
  modified_base (303)..(303): a, c, t, g, unknown or other
  misc_feature (303)..(303): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttatttaacatgtctctggtaccaacaacacccaggacaaacgcccccaaatcatgtattangagtcacgtaagcgcctcgacgggtccctgactcgcttctcgtgctcaagtctagacaacgcgcctccctgaccgtctcgtcgggcctccgaggcgtggaggagtgaggtctagtattattacgtgcagtctactatagtggagcagacgtaatagtttggtagttcgggacggaacggaccaggtccgtacgaccgtcgtaggacgacgacccgtacggcctccgcccccgtggtcctccg

SEQ ID NO: 174548 - DNA, 517 bp, Homo sapiens
  misc_feature: GYAE6OF01AD9AA.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagttatgtctcctggtaccaacaccacccaggcacagcccccaaatcatgatttatgaggtcactaagcgggcctcagggtccctgatcgcttctctggctccaagtctggcgacacggccctccctgacccgtctctgggctccgagctgagatgaggctgattatactgctactcatatgcaggcggcaactcgttgggtgttcgggcggagggaccaagccgtgacccgtcgtaggtcagcccgaaggcctgccccctggtcctaccg

SEQ ID NO: 174549 - DNA, 647 bp, Homo sapiens
  misc_feature: GYAE6OF01DBWH6.22.15.B04.1.454.CMB.1.raw
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgacccagcctgcctccgtgtctggatcatctggacagtcgatcagcatttcctgcacgtgggaccaacagtgactattgggtcttttgactctgtctcctgtaccaacacacccagaccaaaccccccactcactcatttatggtgtcactcgtcgccctcaggagtctctcntcncttctcagctccaagtctggacaacgacgccctaccctaaccacttcctcgtcgggccttccgtaggtttcgaacggtacgtacgttaccttactttaacttactgtctacgtttacctttaaagttacggaccgtacctaccgttcgttccggttcgggttttcgggacgggtacggtaccgtaacccgggtaaacgtccggtacccgttcccggttccgggtacctaaccggccccgtaaacgggtccccgttcccggtcccccccgttacgggttaccctacccgttccgttccccggttcccccccg

SEQ ID NO: 174550 - DNA, 722 bp, Homo sapiens
  misc_feature: GYAE6OF01D69HO.22.15.B04.1.454.CMB.1.raw
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
tcagacatacgcgtcacgaccggtgctcgatttagacagtatatatccgcggggggggtctcaggaggcagcgctctcaggacgtcaccaccatggcctgggctctgctccctcctcagccctcctcactcgagggcacgacgggtccgtcgggcccagtctcgccctgactcacgccctccctccgcggtcccgggtctccgtggacagtcagtccacctatcctcctgccacgtacggaaccngcaggtgtacggttggtagttaataactntcgtctccgtacgtaacccaaacaacccaccgaggaccaaaccgacccccaaatcatgtaatttagngacggtcaacgtacgccggccctcggacgggtccngactcgtcttctcgtcggtctaccgaagttcgtcggaccaaccgtcccggtccctcccgtacggtacccgttccgtcggtcggggtaccctaccggacgggtccgtagggaacgggtacgtagggacggtacgttaggtttaaacttttacgtttaaccgtcgggacctacgttcccgttagtaacgttacgggtacgggaccggacgtaaccgggtaccgttaaacgtttacgggttttcgggtacgggttcgggaacgggtaacgggaccgtaggtccgtacggtacccgtacgtacgggaccacggtacccggtaggtcccgcccgtccccgttggtcctccg

SEQ ID NO: 174551 - DNA, 513 bp, Homo sapiens
  misc_feature: GYAE6OF01C7VZ2.22.15.B04.1.454.CMB.1.raw
  modified_base (431)..(431): a, c, t, g, unknown or other
  misc_feature (431)..(431): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggcaaaagcccccaaactcatgatttatgaggtcactaagcggccctcgaggggtccctgatcgcttctctggctcaagtctggcaacacggcctccctgaccgtctcgtgggctccgaggctgaggatgagctgattattacgtgcagctcatagnggagcagcgactaagtttggtgttcggcggagggaccagcgtgaccgtcgtaggcagcccaaggctcgccccgtgtctaccg

SEQ ID NO: 174552 - DNA, 513 bp, Homo sapiens
  misc_feature: GYAE6OF01EKB28.22.15.B04.1.454.CMB.1.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaatcatgatttangaggtcactaagcggccctgagggtccctgatcgcttctctgctccaagtctggcaacncggcctcctgaccgtctcgtgggctccaggctgaggntgagctgattatacngcagctcatatggagcagcgaatagtttggtagttcgggcggagggaccaaggcgtgaccgtcgtaggccagcccgaagcctacgccccctggtcctaccg

SEQ ID NO: 174553 - DNA, 549 bp, Homo sapiens
  misc_feature: GYAE6OF01ECIHF.22.15.B04.1.454.CMB.1.raw
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (445)..(445): a, c, t, g, unknown or other
  misc_feature (445)..(445): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtccaccatcctcctgcactggaaccagcagtgacgttggtgttataactntgtctcctgtaccaacaacaccaggacaaacgccccaaatcatgattangaggtcactaagccggccctcgacgggtccctgactcgcttctctggctcaagtctgcaacgcggccctcccgtgacccgtctcgtcgggcctccgaggctaggaggtatgaggtctagtaatttagttactgcagtctcattagnggaggcagcgtaactagtttggtcgtcgggcggtacggaccaagtcgtacgacccgttcgtcggtccacgacccgtagcccgtacgtccccctcggtcctaccg

SEQ ID NO: 174554 - DNA, 630 bp, Homo sapiens
  misc_feature: GYAE6OF01EHX00.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttaataactatgtctcctggtaccaacaacacccaggcaaagcccccaaatcatgatttatgaggtcactaagcggccctgacgggtccctgactcgcttctctggctccaagtctggcaacgaccggcctccctgaccgtctcgtgggctccgaggctgaggatgaggctgattattactgcagtctacattagtgggacggtacgaggtacccgtaacgttaagttttcggggtacggtttcccgggggacggggaaaccggggtacccgtaaaagggtcccggttacgggtaaccccggttcccggttaacgggtacccaacgggaccccccggtaaaggggtccccttaccccgggtccccccccgttgggtccccttaaccccgg

SEQ ID NO: 174555 - DNA, 647 bp, Homo sapiens
  misc_feature: GYAE6OF01C6BXV.22.15.B04.1.454.CMB.1.raw
  modified_base (412)..(412): a, c, t, g, unknown or other
  misc_feature (412)..(412): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagacatacgcgtcacgaccggtgctcgatttagacagtatatatccgcgggggagctacaacaggcaggcaggggcagcaagatggtgttgcagacccaggtcttcattttctctgttgctctggatctctggtgcctacggggacattgtgatgacccagtctccagacctccctggctgtgtctcgtgggcgaggacgggccaccatcaactgacaagtccagccagtagttatttttacagtcctaccaaccaaataagtagttaacttagtcgtttcggttaccagacaacgaaaccaggactactcgtcctgcactgctctatttacgtggcgtaccgtaccgggacgtccgggtcctacgaccgtattcgaggtcggcaggtcggtcgtgggacaggtacttcncgtactcaccagtccagcncgcgtacgngacggactagaagtactggtaggctttaagtttattacgttcggtacacgtaacttaaagttacttttaacttacctttacccttaccgttacgttaagggttaaccccggtttaccggaaccggtaaacggggtaaccgtaaaggggttacgaaaaccgtacgtaaaacggtacttacgggtacgtccgttaacgcccgtaaaccg

SEQ ID NO: 174556 - DNA, 621 bp, Homo sapiens
  misc_feature: GYAE6OF01D6QGI.22.15.B04.1.454.CMB.1.raw
  modified_base (225)..(225): a, c, t, g, unknown or other
  misc_feature (225)..(225): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtccaccatctcctgcactggaaccngcagtgacgttggtgttatactatgtctctgtaccacaacaccagacaacgccccaactcatgtattatgagtacactaacgccggtccctcgacgggtccctgactccgtcttctctcggcctacgacgtctggaccaaccgaccggccctcccgtcgtacccgtctcgtcgggcctccgaggtctggaaggtgtcggaacggtctagtaatttattacgtgcaacgtctacagtacgtagggacgacacggtacgtaacttaggtttcgggtcggttccgggacgggaaacggtaccgaagggtccgttacgggtacccgttccggttaacggtaccgaaccggaccccggtaaggccccttacccggtaccccccggtggtaccctaccccgg

SEQ ID NO: 174557 - DNA, 556 bp, Homo sapiens
  misc_feature: GYAE6OF01ADBSM.22.15.B04.1.454.CMB.1.raw
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (547)..(547): a, c, t, g, unknown or other
  misc_feature (547)..(547): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtggttacaagtntgtctcctggtaccaacaacacccaggaccaaaacccccaactcatgatttangagtcactaagcggccctcgacgggtccctgactcgcttctctgctcagtctggcaacncggcctccgtgaccgtctcgtggcctccgaggctgaggatggaggtctgtattattactgcagctacagtagtggaggcagacgtactaagtttgggtcggttcgggacgggtaggaccgaagtccgtacggacccgtcgtaggtccacggtcccgaaggtcccgtaccgcccccgtcggtccnccgttcccg

SEQ ID NO: 174558 - DNA, 740 bp, Homo sapiens
  misc_feature: GYAE6OF01BR603.22.15.B04.1.454.CMB.1.raw
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtcaccatcctcctgcacgtggaaccagcagtgtacgttggtgttataactatgtctccgtggtaaccaacaacaccaggaccaaacgacccccaaatcatgtattatgagtcactaacgcggcctcgacgggtcctgactcgtcttctcgtcgctaccgaagtcgtacggaccaaccgaccggtccctcccgtggacccgttcgtcggtcgggtcctacccgaggtccgtgaagggtactacggagggtccttaggttacttttaacgttaaccgtgaccgtaaggtccttaacgtaagtttacgggacggggaacggtacccggtaacgggtaaccggttaaacgtttaaagggttttttcggggtccgggtttaacccggggacgggggtaaaccgggtaaacccccgttaagggtcccgttaccgggtaaccccggtttacccggtaacgggttaccccgaacccgggtaccccgtaaaccggggttcccctaaccccggggtcccccccggtttgggttaccccgttaaccccgg

SEQ ID NO: 174559 - DNA, 661 bp, Homo sapiens
  misc_feature: GYAE6OF01DRWGG.22.15.B04.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtccctgggcccagtctgccctgactcagcctccctccgcgtccgggtctcctggacagtcagtcaccatctcctgcactggaaccagcagtgacgttggtggttataactatgtctcctggtaccaacaacacccaggacaaacgccccaaatcatgatttangagtcactaagcgccctcgagggtccctgatcgcttcnctggcctaccaagtctggaccaacgaccggccctacccgtgtacccgttctccgtcggggtctcccgaggccgtggacgggatggaaggtctaggtatttattacgtgtacagtctctaagtagtcgggaggtaccgaacgggtacgtaaccgttaaggtttttcgggtacggttacggggtacggggtaaccgggaacccgtaaacggccgttaccggtaacccggttacccggttaaccgggtacccgtaccggaaccccccggtaaacgggtcccgttacccggaccccccccgttcggggtaccccttaaccccgg

SEQ ID NO: 174560 - DNA, 618 bp, Homo sapiens
  misc_feature: GYAE6OF01DMFX4.22.15.B04.1.454.CMB.1.raw
  modified_base (301)..(301): a, c, t, g, unknown or other
  misc_feature (301)..(301): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagccccaaactcatgatttangaggtcactaagcggccctcgacggggttccctgactcgcttctctggctccaagtctggcaacgacggcctccctgaccgtctcgtgggcctccgaggctggaggatggaggctagtattattactgcagtctacagttacgtgggtaggacgagcgtaaccgtaagttttgggtcggtttacggggaccggggtaagggaacccgtaagggccgttacgggtaccccggttacccgttaacggggtacccgaacgggtacccccgtaaacgggtcccgttcccgggacccccccgttcggggtcccttaaccccg

SEQ ID NO: 174561 - DNA, 620 bp, Homo sapiens
  misc_feature: GYAE6OF01A8N1G.22.15.B04.1.454.CMB.1.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggacaaacgcccccaaactcatgatttangagtcactaagcggccctgacgggtccctgatcgcttctctggctcaagtcnggcaacncgccctccgtgacccgtctcgtggcctccgnggctggaggatgacgtctgtatttattacgngcagctacagttagtggacggcaggtaccgtaacttaagttttgggtacggttccgggacggggtaacgggaccctaaagggtcccgtacgggtaaccccggttaccggttacgggtacccgtaaccgggtaccccccggtaaaggggtccccgttacccccgggtaccccccggttcgggttccccttaccccgg

SEQ ID NO: 174562 - DNA, 677 bp, Homo sapiens
  misc_feature: GYAE6OF01BANWG.22.15.B04.1.454.CMB.1.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (316)..(316): a, c, t, g, unknown or other
  misc_feature (316)..(316): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctcgccctgactcacgccctccctccgccgtccgggtctccgtggacagtcagtccaccatctcctgcactcggaaccngcagtgacgttggtagttataactntgtctccgtagtaccaacaaccacccaggaccaaaccgaccccaaatcatagatttanggacgtcaacgtaacgccggccctcggacgggtccctgactcgtcttctcgtcgcctaccgaagtcgtacggaccaaccgcccggtcccttcccgtacggacccgttcgtccggtcgggtcctccggaaggtccgtaggaacgggtagtcgggacgtacgttagtaattttacgtaccgtggacctacggtccttacgtaagttacggtacgggacgtacgaacggacgttaagtttaaggtttcggggtacgttccgggacgggaacgggaccctaagggtccgttcggtaaccccggttcggtaacggacccgaccgtaccggacgtcccgttaccccggccccgttcggccttacccg

SEQ ID NO: 174563 - DNA, 774 bp, Homo sapiens
  misc_feature: GYAE6OF01B9YII.22.15.B04.1.454.CMB.1.raw
  modified_base (302)..(302): a, c, t, g, unknown or other
  misc_feature (302)..(302): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctccgtggacagtcagtcaccatctcctgcactggaaccagcagtgacggttggtagttataactatgtctctgtaccaacaacaccaggacaaacgccccaaatcatgtatttagngaggtacacgtaacggccggtccctacggacggggttccctaggtacttccggtactttccgtacgtcggtaccttacccgtaaacggttccgtacgggtaaccaaacccggtaacccggtcccccgttaccccgtaccggttaccccggtttccgttcccgggttccgggggtaccccttacccgggtaacggggtacccgttagggaaacgggtacgttacgggtaacggttacgttaacggttaacttttaacgtttaaccggtcgaccgtacgttacctacgtaagttacggtagggacggacgtacgtacgtaacgttaaggttttcgggtacgggtttacccggggacgggtaaaccggtaccgtaacgggtacgttacccgggtacccgttaccgggtacggtacccgtaaccggacccggtaacgggtcccgtaccccggtcccccgttggtacccgttacccg

SEQ ID NO: 174564 - DNA, 560 bp, Homo sapiens
  misc_feature: GYAE6OF01DE5KT.22.15.B04.1.454.CMB.1.raw
  modified_base (225)..(225): a, c, t, g, unknown or other
  misc_feature (225)..(225): n is a, c, g, or t
  modified_base (428)..(428): a, c, t, g, unknown or other
  misc_feature (428)..(428): n is a, c, g, or t
tcagacatacgcgtcacgaccggtgctcgatttagacagtatatatccacggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtggttataactatgtctcctggtaccaacaacacccaggcaaacgccccaaactcatgattatgaggtcactaagcggccctcgacggggtccctgactcgtcttctctggctccaagtctggcaacgaccggcctccctgaccgtctccgtgggcctccgaggctgaggagtgaggctgtattattacngcagtctctatagtggagcagcgactaagtttggtcggttcgggcgggaacgggaccgaggccgtacggacccgttccgtaacgggtccacggaccccgaaggtccctccggtcccccctcggtcgtacccg

SEQ ID NO: 174565 - DNA, 511 bp, Homo sapiens
  misc_feature: GYAE6OF01AVO58.22.15.B04.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggnggttataactatgtctcctggtaccaacaacacccaggcaaagcccccaaactcatgatttangaggtcactaagcggccctcaggggtccctgatcgcttctctggctccaagtctggcaacaccggcctccctgacccgtctcgtgggctccgaggctggaggatgaggctgattattactgcagctcatatggaggcagcganaattggngttcggnggaggaccagctgaccgtctggtcagcccaaggcctgccccctggtctaccg

SEQ ID NO: 174566 - DNA, 648 bp, Homo sapiens
  misc_feature: GYAE6OF01BPMP7.22.15.B04.1.454.CMB.1.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcacatctcctgcactggaaccagcagtgacgttggtgttanaactntgtctctgtaccaacaacacccaggacaaacgccccaaactcatgtatttanggacggtacaacgtaagcgggcctcgaacgggttccctgactcgtcttcctcgtcggtcctaccgtaacgtcgtggaccgaccgaccggtccctcccgtcggtacccgtcgtcgtcgggtcctccgtacggcgttagggacggtagtcggacggtcttaggtactttacgttacgtcgtacctactactaagttacgtcggacgtacgggaccggtacgttaaccgtttcggtttacggggttcggttaccggggacggaacgggtaccgaagtcccgtacggtcccgtacgtacggtccaccggaccgacggtccgtacccgtcccccgcggtccgtccgttcccg

SEQ ID NO: 174567 - DNA, 662 bp, Homo sapiens
  misc_feature: GYAE6OF01C9WEG.22.15.B04.1.454.CMB.1.raw
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtgttatactatgtctctggtacaacaacaccaggcaaacgccccaaactcatgatttangaggtcaactaacgcggccctacgacggggtccctgactccgcgtttcctcgtcggtcctaccgaaggtccgtaggacaaaccgtaccgggcccttccgtacggacccgttctcggttcgggccttcccgacgggctaggagggtacgtggaacggcctagtaatttaacgttaacgttgccgtaaggtcctacgtagttaacgtacgggacggtcgaaggtacgtaaccgttaagttttgggttacgggttccgggtacgggtaacgggaaccgaaggtccgtacggtacccgttaccgttagggtacccgaacggacccgtaaacggtcccgtacccggccccccgttggtcccgtaacccg

SEQ ID NO: 174568 - DNA, 556 bp, Homo sapiens
  misc_feature: GYAE6OF01CCYA0.22.15.B04.1.454.CMB.1.raw
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcaggcacagggtcctgggcccagtctgccctgactcagccctccctccgcgtccgggtctcctggacagtcagtcaccatctcctgcactggaaccagcagtgacgttggtgttataactatgtctctagtaccaacaacaccagacaaacgcccccaaatcatgtattangagtacactaagccgccctcgacgggtccctgactcgcttctcgtggctacgaacgtccgacaaccgcgccctcccgtcgaccgtcgtcgtcgggcctccgaggtctaggaggtanggagtctagtaatttattacngctacgctacagtagtgggagcgacgacgtacgtagtttggtaggttccgggagggacggtaccgagcgtcgaccggttcaggtacacgtacccgacgcgtcccgccccgtgtaccc

SEQ ID NO: 174569 - DNA, 713 bp, Homo sapiens
  misc_feature: GYAE6OF01AVHJM.22.15.B04.1.454.CMB.1.raw
  modified_base (324)..(324): a, c, t, g, unknown or other
  misc_feature (324)..(324): n is a, c, g, or t
  modified_base (498)..(498): a, c, t, g, unknown or other
  misc_feature (498)..(498): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagccctcctcactcagggcacagggtcctgggcccagtctgccctgactcacgccctccctccgcgtccgggtctccgtggacagtcagtcaccatcctccgtgcactggaaccagcagtgtacggttggtagttaataactatcgtctcctaggtaacccaactaaaccaccgaggaccaaacgacccccaaatcatgtattanggacgtacactaacgcggaccctcggacgggtcctgacgtccgtcttcgtcgtcggtacctactaacggtcgtacggaccaaccgacccgggtcccctcccgtacggtacccgttccgtcggtcgggtacccgtccgaacgggtccgtacggacgggtacgtagggtaccggtnttaacggtttaactttaacgttcgtacgcctaacggttctacgtaagtacggtacggacggtaccgaggtaaccgtaagttaggtttcgggtacgggttaccgggaacggggtaccggtaaaccgtacggtccggtaccggtaaccccggttccggttaacgtcccggtaaccgaccccgggttaacgtccccggtcccggtcccccgtacccgg

SEQ ID NO: 174570 - DNA, 666 bp, Homo sapiens
  misc_feature: GYAE6OF01EJZ0H.22.15.B04.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (306)..(306): a, c, t, g, unknown or other
  misc_feature (306)..(306): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctctcactcagggcacagggtcctgggcccagtctgccctgactcagcctccctccgcgtccgggtctcctggacngtcagtcaccatctcctgcactggaacccngccagtgacgttggtggttaanaactatgtctcctggtaccaacaacacccaggcaaacgcccccaaaatcaatgatttangagtacactaagccggccctcgacggggtccctgactccgtccttctcgtacggtcctacgtaacgtcgtcggaccaaaccgacccggtccctcccgtacggtacccgtctcggtcgggtcctcccgaggtcctagggtaacgggtacttacgggacggtcgttacggtaacttttaacgttacgtcgacgacgtctaccgaagttagtcgggtaacgcgtacgtaccgaaccgtttaaggtttgggtacggttaccgggcgggtaacgggtaaccaaggtccgtacggtacccgttacggtacggtccgaaccggacccgtaagggtccctacccggtccccgttcggtaccctacccg

SEQ ID NO: 174571 - DNA, 575 bp, Homo sapiens
  misc_feature: GYAE6OF01BD7ZY.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaacgcccccaaatcatgatttatgaggtcactaagcggaccctcaggggtccctgatcgcttctctggctcaagtctggcaacacggccctccctgaccgtctcgtgggcctccgaggtcctggagggtatggaggtctaggtatttacgttactgacagtctcatacgtgggacgcaggacgtactaagttttggtacggtttcgggcgggtacgggacaacggccgtcggtacccgtcgtaggtaccgacgaccccgtaacgggccctacccggtcccccgtcggtcctacccg

SEQ ID NO: 174572 - DNA, 729 bp, Homo sapiens
  misc_feature: GYAE6OF01AZ8UD.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtggttatactatgtctcctggtaccaacaacacccaggacaaacgcccccaaactcatgatttatgagtcacgtaagccgccctcgacgggtccctgacgtctcttcctcgtcggctccaacgtctcggacaaccgaccggccctccctcgtacccgtctccggtcgggtcctccgacggtctaggacgggtagtgggaggtcctaggttactttaacgttacgttcgacgtacgtccttacaacgttaggtcgggaacggtccgtaacgggtaccgtaacgtttaaaggttttcggggttacgggttacccgggggtacggggtaaccggggtacccggtaaaacgggttcccggttaaccgggttaacccccgggttacccgggtttaaccgggtacccggtaacccgggtaaccccccggtaaaccggggttccccgttaccccccgggtaccccccccggtttaccggggttccccttaacccccggg

SEQ ID NO: 174573 - DNA, 635 bp, Homo sapiens
  misc_feature: GYAE6OF01CJFP9.22.15.B04.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctctggacagtcagtcaccatcctccngcactggaaccngcagtgacgttggaggttacaagtntgtctcgtgtacaacaccaccagcacacgaccccaaactcatgtatttagngtacggtctaactaaggcggcctacgacggggtcccngtactcgtctctcgtgcctacaagtcgtggccgacgcccggtcctccgtcgacccgtctacgtcgggtccttcgacggtcgtaggaggtactaggacggtcttagtaactttacgttaccgtcgtacttaacctacttaatagtcggaccgagggtaccgtactacgtttccggttgggggtcgttaccgggacggggtacggaccgtaaggtccggtccggtaccgtaccggttacggaacccacggaaccccggtacgggtaccctcccggtcccccggtacgtcccgttacccg

SEQ ID NO: 174574 - DNA, 650 bp, Homo sapiens
  misc_feature: GYAE6OF01BWS62.22.15.B04.1.454.CMB.1.raw
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttatactatgtctcctgtaccaacaacaccagcaaacgccccaaactcatgtatttatgaggtacactaagccggccctcgacgggtccctgactcgtcttctcgtcggcctccgtaagtcgtcggaccaaccgaccggtccctcccgtacggtacccgttctccgtcgggtcctccgaggtcctggacggtatcggagtcgtaggttatttacgttacgtcgtactacgtctactaagttacggtagggacggtacgtaaggaccgtaagttaagttttcgggttcggttaccggggacgggtaaccgggaaccgtacggtccggttacggtaaccccggttacgttaacgggtacccgtacggaaccccggtaacggtccccgtcccggtccccccggttaccgg

SEQ ID NO: 174575 - DNA, 653 bp, Homo sapiens
  misc_feature: GYAE6OF01B6RJH.22.15.B04.1.454.CMB.1.raw
  modified_base (145)..(145): a, c, t, g, unknown or other
  misc_feature (145)..(145): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagacatacgcgtcacgaccggtgctcgatttagacagtatatatccggcgggggggtctcaggaggcagcgctctcaggacgtcaccgaccatggcctgggctctgctcctcctcagcctcctcactcagggcacagggtccnggcccagtctgccctgacctcagcctcctcgcgtccggtctctggacagtcagtcacatctcctgcactggaaccngcagtgacttggtgttaataactntctctcgtgtaccaanacaccgagactaaacgcccccaaatcaatcgatttagngacgtacactaagcggcctgacgggtcctgacttcgcgtttcncgtggctaccgaagttcgaggcaacgtaccggcctaccgtagtaccgtctcggtcggacctcgagggcctaggagtagtcggaacgtcttaggtaacttacgttcgtacgacgaccgtctacgaagttacgcgggaaccgacgtacggaccgtaaaccgttaaggttttcgggacggtttccggaacggggtaaccgggtaacccaaagggttcccgaacgggtaaccccgttacccgggtacggttaccggaacccgtaaccggaaaccggtcccttaacccggccccccgttaggtaacccttacccgg

SEQ ID NO: 174576 - DNA, 722 bp, Homo sapiens
  misc_feature: GYAE6OF01BDTG1.22.15.B04.1.454.CMB.1.raw
  modified_base (305)..(305): a, c, t, g, unknown or other
  misc_feature (305)..(305): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtcccgggtctcctggacagtcagtcaccatctcctgcactggaaccagcagtgacgttggtgttataactatgtctcctgtaccaacaacacccaggacaaacgaccccaaactcatagatttangacggtcaacgtaacgccggccctacgacgggtccctgacgtcgtccttcgtcgtcggcctaccgaagttcgtacggaccaacgtacccggtccctcccgtcgacccgttccgttcgttacggggccctaccgacggtccgtaggacggtacgttcggagggttccttaggttacttttaacgttacgttcgaccgtacgtccgttactaagtacggttacgggaaggtaccgtacggtaacggttaaccgttaaaggttttcggggtacggtttaccgggggaccggggtaaccgggtaaccgtaaacggtcccggtacgggtaaccccggttccggttaacggttacccgaaacccggacccgtaaccgggtccccgttaccccggccccccggttcgggtacccttaaccccgg

SEQ ID NO: 174577 - DNA, 705 bp, Homo sapiens
  misc_feature: GYAE6OF01BR3O3.22.15.B04.1.454.CMB.1.raw
  modified_base (339)..(339): a, c, t, g, unknown or other
  misc_feature (339)..(339): n is a, c, g, or t
tcagacatacgcgtcacgaccggtgctcgatttagacagtatatatccgcggggggggtctcaggaggcagcgctctcaggacgtcaccaccatggcctgggctctgctcctcctcagccctcctcactcgagggcacgagggtcctgggcccagtctcgccctgactcacgccctcccgtccggcggtcccgggtctccgtggacagtcagtccaccatcctcctgcacgtcggaaccagcagtcgtacggttggtagttaacaagtgtcgtccgtaccgtacggtaaccaacacccaccgaggaccaccaccgacccccaaatcaatgtaatttcgnggacgtcaacgtacgccggtccctcggacgggtccctagactcgtccttacgtcgtcggtacctacgtaacgttcggacggaacctaaaccgcccggtcccttacccgacgtacctctccgtcggtcgggtcctaccgacggtctaaggaacgtacggtaggtacggtacttacgttaacgtttacgttacgtcggtacttacggtaccttagttaacggtttccggaccggtacgggtacccgtacccgttacggtcgggtttcgggtccgggttacgggacgggtaccggaacgtacgtccggtaccgtaccggtacggtcgaccgaccggtacccgacggtcccgtccgtccccgtggtaccc

SEQ ID NO: 174578 - DNA, 592 bp, Homo sapiens
  misc_feature: GYAE6OF01CN4YV.22.15.B04.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (461)..(461): a, c, t, g, unknown or other
  misc_feature (461)..(461): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatcctcctgcactggaaccngcagtgtacgttggtgttataactntgtctctgtacaacacaccagacaacgaccccaactcatcgtatttagtgacgtacaacgtaacggcgcccgtcgacgggtcctgactcgtcttcgtcgtgctacgaagtcaggacacgtaccgcctccgtcgaccgttcgtcgtcggcctcgaggtcgtaggaggactggagtctagtattaacgttcgagtcacgtctatagttagnggacgacgacgtcgtagttaaggtttgggtcggttacgggcggaacgggacgaggtccgtccggtaccggtaccggtacggtcgaccggacccgtacggtcccgtacccggccccgttggtccctacccgg

SEQ ID NO: 174579 - DNA, 656 bp, Homo sapiens
  misc_feature: GYAE6OF01EHIAA.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcacgtggaaccagcagtgtacgttggtagttatactatgtctcctggtaccaacaaccaccaggacaacgacccccaaatcatgtatttatgaggtacactaagccgccctcgacgggtccctgatcgtcttctctgctacagtctcgacaacgccgtcctccctgtacccgtctcgtcgggcctccgaggtcctggacggtagtcggacgggtcttaggttaactttacgtttacgtcgtaccgtaacggtccttaacgtagttaggtacggggtaacggtccggaacggtaccgtaaacgtttaaggttttgggttacgggttccggggaccggggtaacgggtacccgaaggttccgtaccgggtacccggttacggtacgggttaccgaccgggtaccccgaacggtccctaccccggtccccgttcggtccctacccg

SEQ ID NO: 174580 - DNA, 681 bp, Homo sapiens
  misc_feature: GYAE6OF01DVF54.22.15.B04.1.454.CMB.1.raw
  modified_base (208)..(208): a, c, t, g, unknown or other
  misc_feature (208)..(208): n is a, c, g, or t
  modified_base (355)..(355): a, c, t, g, unknown or other
  misc_feature (355)..(355): n is a, c, g, or t
  modified_base (632)..(632): a, c, t, g, unknown or other
  misc_feature (632)..(632): n is a, c, g, or t
tcagacatacgcgtcacgaccggtgctcgatttagacagtatatatccgcgggggctgggggtctcaggaggcagcgctctcaggacgtcaccaccatggcctgggctctgctcctcctcagcctcctcactcgagggcacgagggtcctgggcccagtctcgccctgactcacgccctcccgtccgcggtccgggtctccgtggacngtcacgtcacctattcctccgtgaccgacgtacggaaccagcgtaggtcgtacggtttggttacgttaattaacgtattcgtccttactacgtaaccaacaaccaccgaggaccaaacccgacccctaaatctagtagtactttagnggtaacgtacaacgtacggccgacctcggacggtcctaggtctcgtccttcgcgtcgtacctacgtcggtaccgtcgaaccaaccgccgtacccctaccgtaacctgttccgtcgacggtctaccgttaggttcgagtacgtctactttagtacctatcgttacttaacgtttacttaagggtcacccgtacttcgttaccgttggtttcgggttacggcggtacgaccgtaggtaccgtaccgtccgtccgtacgaccgacgacccgacggttccnccccgtacccgtgtccctacccgtcctttcccggtcccgccccttaacg

SEQ ID NO: 174581 - DNA, 756 bp, Homo sapiens
  misc_feature: GYAE6OF01D49FX.22.15.B04.1.454.CMB.1.raw
  modified_base (255)..(255): a, c, t, g, unknown or other
  misc_feature (255)..(255): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcagggcacgagggtcctgggcccagtctcgccctgactcagccctccctccgcgtccgggtctcctggacagtcagtcaccatcctcctgcactggaaccagcagtgacgttggtagttataactntgtctcgtaggtaccaacaacaccaggacaaacgccccaaatcatgtattatgagtcactaagccgacctgacgggtcctgactcgtcttctcgtcggcctaccgaagtccgtacggaccaaccgtacccgggtcccttacccgtacgtacccgttcgtccggtcggggtacctacccggagggtccgtagggacggtagtacgggtaacggtcgttagttaacttttaacgtttaccgtacggtaccgtaacggttccttacgttaagtttcgggacccgttaaccgggtacccgttacccgttaaaccggttacgggttttcgggggttacggtttaccgggggaaccgggggtaacgggtaaacccgtaacggtaccggttaccgggtaccccggtttacccggtaacgggtaccccggtaccggaaccccggtaacgggtccccgttaccccgggtaccccccggttccgggttacccgttaacccggtttccccgg

SEQ ID NO: 174582 - DNA, 594 bp, Homo sapiens
  misc_feature: GYAE6OF01ES8O4.22.15.B04.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacngtcagtcaccatctcctgcactggaaccngcagtgacgttggtgtataactntgtctcctggtaccaacaacaccaggacaaacgccccaaactcatgattatgagtacactaagccggcctcgacgggtccctgactcgtcttctctcggtctccgaagtcgtcggacaaccgacggtccctccgtcgaccgtcctcgtcgggcctccgaggtctggaggtagtagacggtcgttagtaatttacttacgtcgtacacgtctactagtagtgggagtccaggtacgtaacgttaggtttcggtcggttacgggacgggacgggtacaacggtcgtaccggaccgtacggtacggtccacggtacccgaagtccgtacccggccccgttgtccctaccg

SEQ ID NO: 174583 - DNA, 740 bp, Homo sapiens
  misc_feature: GYAE6OF01EC2C9.22.15.B04.1.454.CMB.1.raw
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcccgtgacagtcgacgtaccacctatcctcctcgacctacgtacggaaccacgcgtaggtcggtacggttgggttagttaaacttaactagtcgtcctccgttacggtaacccaaccgaaccacccgacggaaccaaaccccgaaccccctaaactacagtagttaagtttacgtaggtacggtacaacgtaacggccgtaccctcgggaccggtcctagtactccgtacttcgtcgacggtcctacgtaacgttcgcggacccaaccgaccggtccccttccgtcgtacccggttctcggtacggtcctccgacggtcttagggaacgtagtggaacggtcgtagttaaatttaccgttacgcgtacgtacgtaccttacgaagttacggtaggggacgtacaacgggtaccgtaacttagggtttcgggtcgggttaccgggaaacggggaaccgtaaccgtaacgtccggttaccggtaccccgttacggttaacggaccgacccgtacccggaaccggtcccgttcccccggtccccgttaccgg

SEQ ID NO: 174584 - DNA, 547 bp, Homo sapiens
  misc_feature: GYAE6OF01EVDNS.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacaccaggcaaacgcccccaaatcatgtatttatgaggtcactaacgccgccctcgacggggtccctgactcgcttctcgtcggctccaagtctggaccaacgcggccctcccgtgacccgttcgtcgtcgggcctccgaggtcgtggaggatggaggtctagtatttatactgcagctacatagtggaggcagtcgtaacttaagttggtcggtcggcgggaggacctagcgtcgacgtccgtagacgacgacccgaggcctacgcccctgcctaccg

SEQ ID NO: 174585 - DNA, 756 bp, Homo sapiens
  misc_feature: GYAE6OF01BNAJK.22.15.B04.1.454.CMB.1.raw
  modified_base (233)..(233): a, c, t, g, unknown or other
  misc_feature (233)..(233): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagccctcctcactcagggcacgagggtcctgggcccagtctcgccctgactcagccctccctccgccgtccgggtctccgtggacagtcagtcaccatctcctgcactaggaaccngcagtgtacggttggtaggttataactagtcgttccgtaccgtacggtaacccaactaaccacccgaggacaaaccgacccccaaactcagtcgtatttagtagtacggtaccaacgttaacggcccggtaccctacggtacccggggttccctacggtacgttcccgtaccgtttccgttccgtcggtccttaccgtacgttctacggacctaaccgcccggtccctacccggtcgtaccgtcgtccggtacgtcctcgacggtctagggaacggtgtaggcggtacctaggttacttactacgtacggtaccagtactacaacgttcgggtacggtacggaccgtacgtaacggttaacggtttaacggttcgggttaccgggtaacggggtccggggtaaacgggtacccgtaaacgggtccggtaccggttaaccccggggttacgtaccgggtacgtaaacccggcccggtaacggttcccccaacccgggttcccccgtggttaccccttacccggg

SEQ ID NO: 174586 - DNA, 626 bp, Homo sapiens
  misc_feature: GYAE6OF01AOF1N.22.15.B04.1.454.CMB.1.raw
  modified_base (308)..(308): a, c, t, g, unknown or other
  misc_feature (308)..(308): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatcctcctgcactggaaccagcagtgacgttggtgttaataactatgtctcctggtaaccaacaaccacccaggaccaaaacgcccccaaaatcatgatttangagtcaacgtaacgccggcctacgacgggtccctgactcgtcttcgtctggcctacgaagtcctggaccaacgaccggtaccctcctcgacccgtctcgtcgggcctaccgaggtcctggaacggtagtcggaaggtctagtagtttaacttacgtgactagtcttacaagttacgtcgggaacggtcgaacggtacgtaacgttaaggtttgggtacggttacgggacggtaagggacctaaaggtccgtacgtacccggtacgtacggtaccgacggacccgtaaggccctacccggcccccgttgtccctacccg

SEQ ID NO: 174587 - DNA, 715 bp, Homo sapiens
  misc_feature: GYAE6OF01B6X9I.22.15.B04.1.454.CMB.1.raw
  modified_base (240)..(240): a, c, t, g, unknown or other
  misc_feature (240)..(240): n is a, c, g, or t
  modified_base (532)..(532): a, c, t, g, unknown or other
  misc_feature (532)..(532): n is a, c, g, or t
tcagacatacgcgtcacgaccggtgctcgatttagacagtatatatccgcgggggctggggtctcaggaggcagcgctctcaggacgtcaccacatggcctgggctctgctcctcctcagcctctcactcgagggcacgagggtcctgggcccagtctcgccctgactcacgccctcccgtccgcgtccggtctccgtggacagtcacgtccacctatcctcctgccacgtcggaaaccngctaggtcgtacggtttggtagttaataacttagtcgtccgtccgtacgtaaccaaccacccaccgacggaccaaccgacccgtaacccccaaactctaagttacgtaatttacgtacggtacggtacctaaacggtaacgggcccgggtaccgtaccggtaaccggggtccctaggtacgtccgttccgttccgtcgtccggtacctaccgtaacgtcgtacgggacctaccgtccgtccctccgtccggtacccgttcgtccgtcggccgtacgacggtcgtaggacggngtacgggacgtacgtacgttatttacgtacgtcgtactaactcgtatagtcggacgtacggtaccgtacttacggttcgggtacgggtcggtacggggacggtaaccgggacgtacggtcctaccggtacccgttacgtacggaccgtaccggacccgtaggccctcccgggtccccgtaccg

SEQ ID NO: 174588 - DNA, 730 bp, Homo sapiens
  misc_feature: GYAE6OF01BDAQ5.22.15.B04.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacngtcagtcaccatctctgcactgaaccngcagtgacgttggtgttataactntcgtctctggtaaccaacaacaccagacaaacgccccaatcatgatttangacgtcagtaacgccggtcctacggacgggtcctagtactcgtaccttcgtacgtcggtacctaccgtaacgtccgtacggacctaaccggacccggtcccttacccgtacggtacccgttcgttacggtcgggtccctaccgtacggtccgttaggaacgggtacgtacgggacggtacttagtaacttttacgttaacgtcgtaccgtacgtctaacgtagttaggcgggaacggtacgaacgggtaccgttaactttaagggtttcgggttacgggtaccggggaacggggtaacccgggtaaccgaacgggttacccgtaccgggttacccgttaccggttaaaccgggtccgtaaacccggtaccccggtaaacgggtccccgttaccccgggtaccccccggttacgggtcccgttaacccccggg

SEQ ID NO: 174589 - DNA, 764 bp, Homo sapiens
  misc_feature: GYAE6OF01C0LRV.22.15.B04.1.454.CMB.1.raw
  modified_base (504)..(504): a, c, t, g, unknown or other
  misc_feature (504)..(504): n is a, c, g, or t
  modified_base (547)..(547): a, c, t, g, unknown or other
  misc_feature (547)..(547): n is a, c, g, or t
tcagacatacgcgtcacgaccggtgctcgatttagacagtatatatccgcggggggggtctcaggaggcagcgctctcaggacgtcaccaccatggcctggctctgctcctcctcagcctcctcactcagggcacagggtcctgggcccagtctgccctgactcagcctccctccgcgtccggtctccgtggacagtcagtccaccatcctccgtgccacgtggaacccagcgtagtgtagttggttggtagtttaactaagttagttcgttccttccgtacggtaacccaacgacgacccgaaccgacggaaccaacccgcccccaagtcctacctataccttaatttacgtcgtacgttacgtactaaacgtaccggccccgtaccccgtacgggtaccgggttccctagtcgttccgttcgttccgtcgtcggtcctacgacgttcgcgtaccaaccgtccgttccctaccgtcgacctacgtctccgtacggcctacggngtcaaggacgttacgaggtaccgtgttagttaacgttttaacncggttacgtcgttccgttaccttagtttaccggttacgcccggttaacgggtaccccttaccgttaaccggtttcgggtttccggggttaccggggtacgggggaacccggtaccggtaaacccgggtcgttcccggttaccccggtaaaccccggtttcgtaacccggtacccggaacccgtacccgggtaccggtttccccgtaacccccccggg

SEQ ID NO: 174590 - DNA, 871 bp, Homo sapiens
  misc_feature: GYAE6OF01C3S1P.22.15.B04.1.454.CMB.1.raw
  modified_base (177)..(177): a, c, t, g, unknown or other
  misc_feature (177)..(177): n is a, c, g, or t
  modified_base (234)..(234): a, c, t, g, unknown or other
  misc_feature (234)..(234): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctcgccctgactcacgcctcccnccgcgtccggtctccgtggacagtcagtcaccatcctcctgacctactacggaaccngctaggtcgtacggttggtagttaactaacgtagttcgttcctaccgtaggtaacccaaaaccaaccgtaaccccgaaggaacccaaaccggtaaccccccaaaactccgaattacggtaacttttacgacggtaacggtaccaacggttaacgggccgggtcctacggtaccggggtccctaggtaaccgtccgttctttccgtcggtaccggtaccgttacccgtaacgttccggtacgggaccgtaacccggtacccggtccccttacccgtacggtacccgtttccgtaccgggtaccgggtcccgttacccggagggttaccggtacgggaagggtacgtagggaacggttcgttaagttaacgtttaacgtttaccggtacgtaccttaaccgttactaagttaccgttacggacggtaacgggccccggtaactttacccggttacgggtttcggggttaccggggttaccgggaaccgggggtaaccgtaacccggagggttcccgtaccgggttaaccccgttacgggtaaccggtacccggtaacccgggaaccccgggttaacggtccccccgttacccgggtacccccccgtttcccggtacccgttaccccgggtttccccccg

SEQ ID NO: 174591 - DNA, 711 bp, Homo sapiens
  misc_feature: GYAE6OF01DWTOD.22.15.B04.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
tcagacatacgcgtcacgaccggtgctcgatttagacagtatatatccgcggggggggtctcaggaggcagcgctctcaggacgtcaccaccatggcctgggctctgctcctcctcagccctcctcactcagggcacgagggtcctgggcccagtctcgccctgactcacgccctccctccgcgtccggtctcctggacngtcagtcaccatctccngcactcggaaccngcagtgtacggttggtaggttaactaactatgtcctccgtcggtaaccaacaaccaccaggaccaaacgacccccaaatcatgtattangagtcacgtacgcgcctgacgggtccngactcgcttctcgtcgtctacaacgtcgtacggaccaaccgaccggtcctcccgtacgacccgttctaccggtcggggcccttaccggagggtacgtggaacggtacgtcgggaaggtccttaagttactttaacgttaccgtcgacgtaacgtcttacgtaagttaaggtacgggaccgaacgtaacgggtacgttaacggttaaggttttccggggttaggttaccggggacggttaaagggaccctaacgggttccggttaacggtacccccggtttacgttaaccggggacccgtaaccgggtacccgtaacgggttccccttacccccgggtcccccccgtttggacccgtttaccccgg

SEQ ID NO: 174592 - DNA, 657 bp, Homo sapiens
  misc_feature: GYAE6OF01CV2RN.22.15.B04.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctggccagtctcgccctgactcacgcctccctcgcgtccggtctccgtggacagtcagtcaccatctcctgcactaggaaccngcagtcgacggttggtagtataactntcgtctctcgacaacacaccagacaaacgccccaancatgtattangagtcactagcgcctcgcgggtcctgactcgtcttctcgtcgacctacaacgtcgtacggaccaacacccggtcctacccgtcgtaccgtcgtccgttcgggtcctaccgacggtactaggaacggtagttaggacggtattacggtaatttacgttacgtacgtaccgtagtccctaagttaagtacggtacgggacgacgtaacggaccgttaacgtttaggttttaccgggtgggttaccgggaacgggttaaccgggaaccgtacggtcggtaaccgtacccggttacgtaacgggtacccgtaccgtaaccggtacgggtcccctacccggtccccggtccgttcttaccccgg

SEQ ID NO: 174593 - DNA, 690 bp, Homo sapiens
  misc_feature: GYAE6OF01BEP4X.22.15.B04.1.454.CMB.1.raw
  modified_base (372)..(372): a, c, t, g, unknown or other
  misc_feature (372)..(372): n is a, c, g, or t
  modified_base (552)..(552): a, c, t, g, unknown or other
  misc_feature (552)..(552): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacgacgggtcctcgggcccagtctcgccctgactcagccctccctccgcggtcccgggtctccgtggacacgtcagtcaccagtcctcctgacacgtacggaaccagcacggtcgtacggtttgggttacggtttaataacttagtcggttacctccgttacggtaacccaaaccaaaccgaacccgaaggaacccgaaaaccgaccccctaaaactcctaatacgtaattttaagnggtaacggtactaaccgtaacggcccggtcccgtacgtaaccgggggtccctaggtactccggtactttccgacgtcgaccctacgaacgttcgacgaccaaccgccgtacccttccgcgtaccgtcgcgtcgggctcggacgtgtacggagagtggacgtctaagttcttaattaccgngacagtctagtaacgtggtaaccggagacgacggacgtaagtttacgttgggtacgtccgggaggtacggacacggacgtcggaccgttacgcggtacgccgaacgtacggccttacccggcccgttcgcttacccgg

SEQ ID NO: 174594 - DNA, 676 bp, Homo sapiens
  misc_feature: GYAE6OF01D9IUF.22.15.B04.1.454.CMB.1.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacgagggtcctgggcccagtctgccctgactcacgcctccctcgcgtccgggtctcctggacngtcagtcaccatctcctgcactggaaccagctagtgacgttggtgttanaactntgtctctgtaccacacaccagcaacgccccaaatcatgtatttagtgaggtacacgtaacgccgaccctgacgggtccctgatcgcttctcgtcggcctacgtagtcgcgacaaccgcgtccctccgcgaccgtctcggtacgcctcgcgtacggtgtagtagacgggacgtcgtaagtttaattaccgtttcacgtcgtactccttaacgtactaagggtcgggtacgacgaccggtaacgtaagtttaaccggtttgggttaccggttacccggggtacgggtaaaccggtaacccggtacgttacccgggtaaccgggttacccgttaaccgggttaccggtaaacccgggtacgaacccccgggttaacggaccccggtttaccccccgtacccccggttaaccggttcccgttaacccccg

SEQ ID NO: 174595 - DNA, 600 bp, Homo sapiens
  misc_feature: GYAE6OF01BAFH6.22.15.B04.1.454.CMB.1.raw
  modified_base (250)..(250): a, c, t, g, unknown or other
  misc_feature (250)..(250): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctcctggtaccaacaacaccagacaaacgcccccaaatcatgatttatggaggtacactaacgccggtccctcgacggggtccctgactcgccttctctcggctacgagtcgtcggacaacgccggtccctcccgtcgacccgtcgttcgtcgggtcctccggaggtcgtggaggtactggacggtcgtagtatttacgttacgtcgtactactactatgtgacgacggcgtactacgttcggttgggtcggttcgggacgggtacggacctacggcgtacggtcccgtacgtacggtccgaccggacccgacggtccgtcccgccccgttcggtcctccgttcccg

SEQ ID NO: 174596 - DNA, 611 bp, Homo sapiens
  misc_feature: GYAE6OF01BLVZC.22.15.B04.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
  modified_base (456)..(456): a, c, t, g, unknown or other
  misc_feature (456)..(456): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacngtcagtcaccntcctcctgcacgtcggaaccngcagtggacgttggtgttataactntcgtctcctggtaacccaacaaccaccgaggacaaacgcccccaagtcatgtattagngacgtacacgtagccgtcctcgcgggtcctgactccgtcttctcgtcggctacgtagtcgtcgaccaacgccgtccctccgcgtacccgtcgtacgtcggtcctccgaggtcgtaggacgtgtggagtcgtagtacttatcgngctacgtctacgattaggcggacgtccgagtaccgtagtttacggttcgggtacggtcgggaacgggtacggtacacggttccgacggtacccgtacggtcggacctaaccggacccggtagcccttaccccggccccgttggtcccttacccgg

SEQ ID NO: 174597 - DNA, 604 bp, Homo sapiens
  misc_feature: GYAE6OF01EH5JY.22.15.B04.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
  modified_base (441)..(441): a, c, t, g, unknown or other
  misc_feature (441)..(441): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtccggtctaccgtggacagtcagtccaccgatcctcctgcactggaaccngcagtgacgttggtagttanaactatgtctcctggtaccaacaacaccaggcaaacgcccccaaatcatgatttangagtcacgtaagccgcctgacgggtccctagactcgtcttctcgtggcctcgaagtctggaccaacgaccggccctcctcgacctctcgtggcctccgagctaggaggtactggacgtctagaatttacgttacnggaccagtctactatagtggacggactagacgtacgttaagtttcggacggttccgggacggaaggtacccgaaggtccgtaacggtacccggttaccgtaacggttaccgaacgtccccggtaaggccccttacccggtccccccgttggccttaaccccgg

SEQ ID NO: 174598 - DNA, 740 bp, Homo sapiens
  misc_feature: GYAE6OF01EWTCZ.22.15.B04.1.454.CMB.1.raw
  modified_base (296)..(297): a, c, t, g, unknown or other
  misc_feature (296)..(297): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagttatgtctcctggtaccaacaccacccaggcacacgcccccctaaaacnntactatatagtagtttacgtacgtaacggtacgtaccgtaacggtccggggtcccgtacgacgggtacccgttacggtacgttccgtcgttccgttccgttacggtaccgttaccgtaacggttaccgtaccgggtacccggtacccgtaccggtacccgttcccgtaccgtacccggtccgttccgtacgggtaccgttacccggtacgggtacgtcggtacggacttcgtaagggtacttacgtacgttacgtttacgttacgtacttaacttacgtactaacgtcgggtacgtaacggtcggtacggtaccgttaccggttcggggtacgggttaccgggtaccggacgggtaccgtaaccggtacccgttccggtacccggtacccgtaccggtaccggaccggtaccccgtaaccccggtcccggtcccgtacccccg

SEQ ID NO: 174599 - DNA, 713 bp, Homo sapiens
  misc_feature: GYAE6OF01ETFRV.22.15.B04.1.454.CMB.1.raw
  modified_base (301)..(301): a, c, t, g, unknown or other
  misc_feature (301)..(301): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttataactatgtctctggtaaccaacaacaccaggaccaaacgcccccaaatcatgatttanagacgtcaacgtaacgccggcctgacgggtccctgactccgtacttcgtcgtcggctaccgaagtcgtaggaccaacgccggtcccctcccgtacggtacccgttcgtccgtacgggtccctacccgtacggtcctaggtaacggacgttcggaacggtcttacgtaattttacgttaacgtcgacgtacgtaccttacgtaagttacggtcgggaacggtaccgaagggtaacccgttaaacgtttaacggttttcggggtacggtttaccggggacggggtaaaccgggtacccgaaagggttcccgtaaccgggtaccccggttaccggttaacgggtacccgaaccgggtacccccggtaagggtccccgttacccggtcccccccggttacgggtaccctaccccgg

SEQ ID NO: 174600 - DNA, 627 bp, Homo sapiens
  misc_feature: GYAE6OF01CR6EJ.22.15.B04.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacngtcagtcaccatctcctgcactggaaccngcagtgacgttggtagttataactntgtctctgtaccaacaacaccaggacaacgccccaactcatgatttangagtcactaagcgcctcgacgggtcctgactcgcttctctgctcagtctgcacgcgcctcctcgccgtctcgtcggctccgaggtctggacggataggacggtctagtaacttacttacgtcgactacgtcctacgtaacgttagtacgggaacgtccgacgtacgaactttaaggtttcgggttacgggttccgggtacggggtaacgggacccgtaacggtaccgtaccggtaacccggttccggtaacgggtacccgaaccggtaccccggtaaaccgggttcccgttacccggttacccccccggtcggttcccgttaccccgg

SEQ ID NO: 174601 - DNA, 755 bp, Homo sapiens
  misc_feature: GYAE6OF01DJTSO.22.15.B04.1.454.CMB.1.raw
  modified_base (226)..(226): a, c, t, g, unknown or other
  misc_feature (226)..(226): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctctcactcagggcacaggtcctgggcccagtctgccctgactcacgccctccctcgcgtccggtctccgtggacagtcagtccaccatctcctgcactcggaaccngcaggtgacggtttggtagttaacaactatcgtcctccgtacgtaacccaaacaaaccctacccgaaggacctaaaaccggaccccctaaaacgtctaagtacgttaacttttacgagggtaacgttacctaaaccgtaacgttcccggtacccgttacgggtaaccggggttcccctagtaactccggtactttccgtcgtacggtcctaccgaagttccgtagacccaaaccgtccggtcccttacccgtacgtacccgttctccgggtacggaccctacggacggtaccgtaggaacgggtacgttggaacgtaccgttagttaacgtttactaacgtcgaaccttgtacccttagaacgtttaggaagggccgtaacgacggtacctaaaggtttacggtttggggtacggttccggggaaggtaccgggacctacgtccgtaaccggtacccgttacggtacggaaaccgtcccgaaaccggtccggtacccctaccggaccccggttccgtaccggttacccg

SEQ ID NO: 174602 - DNA, 775 bp, Homo sapiens
  misc_feature: GYAE6OF01BG2D4.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctccctcctcagcctcctcactcagggcacgagggtcctcgggcccagtctgccctgactcacgccctccctccgccgtccgggtctcctggacagtcacgtcaaccatcctcctgcacgtacggaaccagctagtcgtacgtttgggtagtttaataactatcgtcctaccgtaggtaaccaaacaaccaacccgaggaaccaaaccgaccccaaactcacttagtatttagtcggacgtacaacgtaacggccggtacctacggacggggttccctagtacctccgtccttccgtcgtccggtactaacccgtaagtccgtacggacaaaccggccgtcccgttacccgacggtaccccgtcgttccggtacgggtcccttaccggacggtccgtaggaacggtacgtagggacggtactagttaactttactcggtacgacgtacgtccttaagacttacgggtagggacgtacgtaaccggagttaacgtttagggtttacgggggttacggtcccgggtaaacggggaccgggtaaaccgtaaggttccgggaaccggttacccggttaaccgggtccgggttaaccgaacccggtaaacccggggtaacccgttccccgggtccccggttaacccccggttcggtaaccccgttaccccggg

SEQ ID NO: 174603 - DNA, 653 bp, Homo sapiens
  misc_feature: GYAE6OF01BV2D7.22.15.B04.1.454.CMB.1.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcgagggcacgagggtccgtcgggcccagtctcgccctgactcacgccctcccgtccgccggtcccggtctccgtggacacgtcacgtccaccatcctctgcagtacgacagctagtgtcgttggtagttaataacgtntcgtctctacgtaaccaaccaacgaccgagaccaaaccgaccccaatnagtatattagtgacgtacgacgtaccggccggtaccctacgggtaccggtccgtagtacgtccgttacttccgtcgtacgtcctacgtagttcgacgccgaacgcccgtccctccgtacgtacgttcgtcgtacggtcctcgagngtacgganggtagacgttgtagtacttactacgacgtcgtacgtctaagtagtaggacgaacgctaacggtacttaaaggtcggttttcggacgggttcgggaaaccggcggtaactagggtccgtaccgtacggtacgtacggacccgtacgccgtaccggtccctacccgggtccctacggtcccgtaccg

SEQ ID NO: 174604 - DNA, 706 bp, Homo sapiens
  misc_feature: GYAE6OF01DQGIF.22.15.B04.1.454.CMB.1.raw
  modified_base (230)..(230): a, c, t, g, unknown or other
  misc_feature (230)..(230): n is a, c, g, or t
  modified_base (287)..(287): a, c, t, g, unknown or other
  misc_feature (287)..(287): n is a, c, g, or t
  modified_base (422)..(422): a, c, t, g, unknown or other
  misc_feature (422)..(422): n is a, c, g, or t
tcagacatacgcgtcacgaccggtgctcgatttagacagtatatatccggcgggggggggtctcagggaggcagcgctctcaggacgtcaccaccatggcctgggctctgctcctcctcagcctcctcactcgagggcacgagggtcctcgggcccaggtctcgccctgactcacgtccctcccgtccggcggtccggtctccgtggacacgtcagtcacctatcctccnggacctactacgggaaccagcaaggttcggtacggtttgggtaggttaactaacgtnttcggttccttcctacggtaaccaaacaaccaccgaaggaccaaaccgccccctaaaacgtccaattagtatttagacggaacgtacacgtaacggccggtacccgtagtaccgggtcctaggactcgtacttcncgtgcctacgaacgttcgacgacaccgcgtccctaccgtcgtcctcgtcgtcgactccgaacgctaggaggtagtcggacgtctagttaacgttaacttcgtgcctaggcctagtacgtagtggggaacacggacgtaccgttaagggttaacctttggggggtaccgttcggggaaccggggtaacggaccgtaaggtccggtacccggtaacgttccggtaaacgggccgaaaccggtccccggtaacggtcctacccgccccgggttacgtcgttcccccg

SEQ ID NO: 174605 - DNA, 603 bp, Homo sapiens
  misc_feature: GYAE6OF01DCSK1.22.15.B04.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
tcagacatacgcgtcacgaccggtgctcgatttagacagtatatatccgcggggggggtctcaggaggcagcgctctcaggacgtcaccaccatggcctgggctctgctccctcctcagccctcctcactcgagggcacagggtcctgggcccagtctgccctgactcagccctccctcgcgtccgggtctctggacngtcagtcaccntctctgcactggaaccagcagtgacgttggtagttactactatgtctccgtacgtaccaacaaccaccagacaaaccgacccaaactcatgtattangagtcactacgcgccncgtacgggtcctgactcgtcttcgtctcgtctacgagtcgtagacacgacggcctcctacgtacgtccgtgtcggactccgaggtcgtaggaggtatgggacggtacgtgttacttagttacgcgtacacgtctatagtacggtaggtacgacgacgtacgtacgttaaggtttgggtacggttcgggacgggaacgggactacggtccgtaccggacccgttacggtacgtacccgacggaccggtaacggccgtacccggccccggtgtccgttacccg

SEQ ID NO: 174606 - DNA, 815 bp, Homo sapiens
  misc_feature: GYAE6OF01DYKFX.22.15.B04.1.454.CMB.1.raw
  modified_base (235)..(235): a, c, t, g, unknown or other
  misc_feature (235)..(235): n is a, c, g, or t
tcagacatacgcgtcacgaccggtgctcgatttagacagtatatatccggcggggggggtctcaggaggcagcgctctcaggacgtcaccaccatggcctgggctctgctcctcctcagccctcctcactcgagggcacgaggtcctgggcccagtctcgccctgactcacgtccctcctccgcggtccgggtctccgtggacagtcagtccaccatcctctgcactcggaaccngcagtgtacgttggtacgttatactatcgtctccgtacggtaaccaaacaaccgacccgacggaaccaaaccggacccccaaactactaagttacgtaatttacgtacggtaacggtcctaaacgtaacggtccggtaccctacggtaccggggtccctaggtaccgtccgtaccgtttccgtccgttcggtacctaccgtaacgttccgttacgggaaccaaccgtacccgtcccttcccgtacggtacccgttctacggtcgtccgttaccgacggtcgtaggacggtagtacggtacggttacgttacgttatttacgttaccgtgacctaacggtccttacgtaagttacgggaccggtacggtaccgaacgggttaccggttaaacggtttacgggttttacgggttacggggttaccggggaaaccggggtaacgggtaacccgtaacggtcccgggttaaaccgggttaccccgggttaacggtacccggtacccggtaaccgtaacccccgggtaacggttcccccgtaacccccgggtttccccccggttcggttaaaccccttccccggg

SEQ ID NO: 174607 - DNA, 703 bp, Homo sapiens
  misc_feature: GYAE6OF01ECO41.22.15.B04.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
tcagacatacgcgtcacgaccggtgctcgatttagacagtatatatccgcgggggggtctcaggaggcagcgctctcaggacgtcaccaccatggcctgggctctgctcctcctcagccctcctcactcgagggcacgagggtccgtgggcccagtctcgccctgactcacgcctcccgccgtcgtcccgggtctccgtggactacgtcagtccaccatctacctgcacgtggaaccngcagtgacgttgtagtataacntgtctctagtacaacaaccaccaagcaacgaccccaatcgatagtattanaggacgtanaacgtaacggccggcctgacgggtccaggactcgtcttctgtcggtacctacgaagtcgtacggcctaaccgtcccgaccctccgacgtaccgttccgtcggtcggtaccgtccgtaggaccgtaggaacggtacgtaggacggttacgtacgttagtttacgtacgtacgcgaacgttctacgtagtacgttacgggacgtacggtaacgtccggttaactttaacgggtttcggggtaacggtccggggtaacgggaaccggttaacccggtaggttacccgtaccggttaccccggttacgggtacgtaacccggtacccgggaaccgttaaccccggtacggttcccccggaccccgggttccgttaacgtccccccggg

SEQ ID NO: 174608 - DNA, 615 bp, Homo sapiens
  misc_feature: GYAE6OF01B6U4S.22.15.B04.1.454.CMB.1.raw
  modified_base (154)..(154): a, c, t, g, unknown or other
  misc_feature (154)..(154): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (364)..(364): a, c, t, g, unknown or other
  misc_feature (364)..(364): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (536)..(536): a, c, t, g, unknown or other
  misc_feature (536)..(536): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (592)..(592): a, c, t, g, unknown or other
  misc_feature (592)..(592): n is a, c, g, or t
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
tcagacatacgcgtcacgaccggtgctcgatttagacagtatatatccgcggggggggtctcaggaggcagcgctctcaggacgtcaccaccatggcctgggctctgctcctcctcacgcctcctcactcgagggcacgagggtcctgggcccngtctcgccctgactcacgccctccctcgccggtccggtctcgnggacngtcagtcaacctntctcctgccacgacggaaccagcgaggtacgtaaccggtttgggaggtttaataacctagtcgtcctacgtacgaaccaaacgaacaccaggacaaaccgccccaatcaatgtatatgtacgacagtaacgccgcgtacggcggttccngacgtcgactttaccgcgtacgccgtacgtacgcgtagacctaaacgccgtcctaccgtnaactcgtcttcgctcgaacggngacgtaagacgaggttaggacggtacttacgttaagttaaccgtttcacgtcgttactgtaacgttcgttgaccgtacgccgtctaacgnggttcgggtgacggtaggacgtacngtaccgnggaccttcggatcggacaccgtcnccgtacccncgtccggntccccg

SEQ ID NO: 174609 - DNA, 618 bp, Homo sapiens
  misc_feature: GYAE6OF01DD9OW.22.15.B04.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
tcagacatacgcgtcacgaccggtgctcgatttagacagtatatatccggcggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagctattcctgcacgtggaccaangtgactagttgggtctttgactctgtctccgtagtaaccaacaaccaccacgacccaaacccccatcatctattagngtntcactcgtcgcctgagctctactcatcgtcttctcgagtctaccgtaagtcgtacgaccacgaccggccctaccctaacntctcgtcggtctacgtagttacgacgtcgtacttacttacttattacgtcgtaccgttacgtttaactttaaagtcggacctctacgttcgttacggttcgggtttcggacggtacggtaccgtacggtagtaccgtcccgtccggtcgtccgaccgtacccgaacggtcccgtcccggtcccccgtcggtacccgtccttaccgtccccgttcccgtcccttacccg

SEQ ID NO: 174610 - DNA, 730 bp, Homo sapiens
  misc_feature: GYAE6OF01BLB7O.22.15.B04.1.454.CMB.1.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtagttaataactntgtctctggtaccaacaacacccaggacaaacgcccccaaactcatgatttatgagtacactaagcggcctcgacgggtccctgactcgacttcgtctggtctaccgtaagtcgtggaccaaccgacccggtccctcccgtcgtacccgtctccgtcggggccctccgaaggtccgtaggtaacgggatgggaacggtcttaggtaactttagtttaacgtgtaccgagtacctaccgaagttacgtacggggtaacggtaccgaacgggtaaccgtaaccgtttaaagggttttcggggttacgggttaccggggtaccgggggtaaccggggttaaaaccgaacgggtacccgttaaccgggtaacccccgggttaccgggttaacccgggtaaccgaaaccggtacccccggtaaaccgggtcccgtttacccccgggaccccccccgtttacgggggttacccttaaccccccgg

SEQ ID NO: 174611 - DNA, 627 bp, Homo sapiens
  misc_feature: GYAE6OF01DRYV2.22.15.B04.1.454.CMB.1.raw
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (450)..(450): a, c, t, g, unknown or other
  misc_feature (450)..(450): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacatcagtcaccatctcctgccacgtaggaaccngctagtgtacggttggtgttataactatntctcctaggaccaacaccaaccagacaaccaccccaaactcatagtatttagngaggtccaataacgccggccctcgacgggtccctgactccgtcttcgtactcggcctacaacgtcgaggaccaaccgtaccggtcccgtccctcggacccgttctccggtcgggcctcgtacggcgtagacggtatggacgnttcggtaatttagttactagtactctctagtagtgggacgtcgacggtacgtaacgttagtttacgtggttacgggcggttaacggaccggtaacggcgtaccggtaccggtaccgtacggtacgaccggtaccgtacggtcccgtacgtcccccggtcgttccgacccgttccccg

SEQ ID NO: 174612 - DNA, 801 bp, Homo sapiens
  misc_feature: GYAE6OF01B8VSW.22.15.B04.1.454.CMB.1.raw
  modified_base (168)..(168): a, c, t, g, unknown or other
  misc_feature (168)..(168): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctcgccctgactcncgcctccctccgcgtccggtctcgtggacacgtcacgtccacctatcctcctgcacgtcggaaccagcagtgtacggttggtaggttataactgtcgtctccgtagtaccaacaacaccgagaccaaacgccccaaatcaatcgtattacgcgtacgtactacgtaacgccgacccgtagacgggtcctagactcgcttccgtcgtcggtacctaccggaacgttccgaggaccctaaccggccgtcccctccgttacggtacccgtcgtacgtcgggacctccggacgtacgtacggagtacgtaggaccggtagtacgttaacttacgtacgtacggctacgttacgtacgtaacgacggttaccgggaacgtaccggtaacgttaacccggtaaacggttttaaagggttttcccgggggttacgtaaccccgggggggtaaacgggttaacccggggaaacccgtaacggggttacccggttaaccccggggtaaacccccggtttaacggtaacccgggtttaaaccccgggaaaccggttacccccgggggtaaaaccggttccccccgtttaaaccccccggggttccccccgtttaaggggttaacccccggttttacccccggg

SEQ ID NO: 174613 - DNA, 757 bp, Homo sapiens
  misc_feature: GYAE6OF01E0QA4.22.15.B04.1.454.CMB.1.raw
  modified_base (242)..(242): a, c, t, g, unknown or other
  misc_feature (242)..(242): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcaggggcacgaggggtcctgggcccagtctcgccctgactcacgccctcccgtccgcggtcccgggtcctcctggacagtcagtcacctactctcctgacacgtacggaaccngactaggtggtacggttggtaggttaataactatgtctcctcggtaaccaactaaccacccaggacaaacgacccccaaactccatgtattntagacgtnaacgtacgccggcctcgacgggtcctagactcgcttcncgtgctaccgagtcgtacggacaaccgtaccgccctaccgtcgtaccgttcgtccgtcgggtccctacggcggtaccgtaggacggtacgtaggtacggttattacgtaattttacgtacgtcggacgtacgtcgttaccgagttaggtacgggtacggacgaacgggtacccgttaaaggttaacggtttcgggtacgggttccggggaagggggtaaccgttaaaccgggaacggttacccgggaccgggttaaacccccgggttcccggttaaacgggtaccccgtaaaccgggtacccccgggtaacggggtaccccgttaccccccgggttaccccccggtttaaccccgggtccccttaaacccccccggg

SEQ ID NO: 174614 - DNA, 688 bp, Homo sapiens
  misc_feature: GYAE6OF01EG14E.22.15.B04.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (626)..(626): a, c, t, g, unknown or other
  misc_feature (626)..(626): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacgagggtcctgggcccagtctcgccctgactcacgcctcgctcagtcgtccgggtctccgtggacagtcagtccaccatctcctacacgtacggaaccagcagtgagttggttaggtagttataactatgtcctccgtacggtaaccaacgacnccgaacccgaggaccaaaccgtccccaagactcaatctagtttacngtactagtactaaagtacgccgtcctacggtaccgggtcctagactccgtcttcgtcgtcgtcctacgtacgtccgtacggacctaacggtcccgtcccttaccgtacgaacccttacgtccgtacgggtccggtaccctacggacgggtctaagggagtacgtcggaacgtctagttaactttcgttaccgtggttactacgttcgttaacgttcgttacgaccggaccgtacgtacccgttggttacgggttccggggtcggtaccgggaccgggtaacggtaacccnggttacccggtacgttacccgggttagtacccggtacgaacccgtcccgggtagtcccccgg

SEQ ID NO: 174615 - DNA, 706 bp, Homo sapiens
  misc_feature: GYAE6OF01CJTFI.22.15.B04.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (439)..(439): a, c, t, g, unknown or other
  misc_feature (439)..(439): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactggaaccngcagtgacgttggngattataactatgtctccgtgtaccaacaaccaccaggacaaacgcccccaaactcatntattangagtacactaacggccgtccctcgacgggtcctgactcgtcttctcgtcggcctaccgaagtccgtcggaccaaaccgacccggtcccttcccctacggaccccgttaccgtccggtaccgggtcctacccggngggtaccgtagggtaaggtacgtcgggaacgggtaccgttagtaacttttaacttccggtacgccgtaagtccttaactaaggtagtacggggacggtacctacggtacggttaaacttaagggttttcgggtacgggtttccgggggacgggtaaccgggaaacccgtacgggtccggttaccggtacccggttaccgggtacggtacccgtaccggaacccggtacggtaccccggtccccgtaccccccgggttcgtaccccgg

SEQ ID NO: 174616 - DNA, 654 bp, Homo sapiens
  misc_feature: GYAE6OF01AKPWK.22.15.B04.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (468)..(468): a, c, t, g, unknown or other
  misc_feature (468)..(468): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttatactatgtctctgtaccaacacaccagacaaacgccccaatcatgtattangacgtacacgtaacgccggtccctcgacgggtccctgacgtcgtcctttcgtcgtcggtctaccgaagtccgtacgaccaacgaccggtccctccgtacgtacccgtcgtcgtcggggcctaccgaggtcgtaggaacggtacgtaggacgtcttaagtacttacttacgcgacncgtactacgtagtaggtggacgtacgacgtacgtaacttaggtttcgggttcggtaccgggacgggtacgggtaaacccgaaggtccgttaaccggtaccgttaccggtaacggtacccggaaaccgtaccccgggtaacggttccccgtacccccggtcccccggttccggtcccgttaccccgg

SEQ ID NO: 174617 - DNA, 757 bp, Homo sapiens
  misc_feature: GYAE6OF01BVQWL.22.15.B04.1.454.CMB.1.raw
  modified_base (262)..(262): a, c, t, g, unknown or other
  misc_feature (262)..(262): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcagggcacagggtcctgggcccagtctcgccctgactcagccctccctccgcggtccgggtctccgtggacacgtcagtccaccatctcctgcacgtggaccagcagtcgtacgttggtaggttataaacgtntgtcctccgtacggtaacccaaacaaccaacccgaggaaccaaaccgccccctaaactctaactcgtaatttacgacggtacgtacgaacgtaacggcccggtaccctacggaccggggttccctaggtactcggtccttactcgtcggtctacgtaacgtctacgggacctaaaccgaccggtcccttccccgtaggtaccccgttcgtacgggtccgggtacctaccggtaccgggtacgttacggtacgggtacgtacgggtacgggtaccttaggttaacgtttaacgtaacgtcgtaccgtaacgtcgttaacagttacggagggtacggtcggaacggtaccggttaacgttaacgggtttgggttaacgggtccgggaacggggtaacggaaccgtagggtaccgtaccggttacccgttcgggtacggtcccgtaaccgtacccggtaaacgggtcccgtacccggtaccccggtcgtccgtacccg

SEQ ID NO: 174618 - DNA, 687 bp, Homo sapiens
  misc_feature: GYAE6OF01BLGKC.22.15.B04.1.454.CMB.1.raw
  modified_base (203)..(203): a, c, t, g, unknown or other
  misc_feature (203)..(203): n is a, c, g, or t
  modified_base (640)..(640): a, c, t, g, unknown or other
  misc_feature (640)..(640): n is a, c, g, or t
tcagacatacgcgtcacgaccggtgctcgatttagacagtatatatccggcggggggggtctcaggaggcagcgctctcaggacgtcaccaccatggcctgggctctgcctcctcctcagcctctcactcgagggcacgagggtcctgggcccagtctcgccctgactcacgccctccctccgcgtccgggtctccgtggacngtcacgtccaaccattcctcctagcctacgtacgggaaacccaggcctaggtcgtaccggtttgggtagttaataacttagtgtcctccgtacggtaacccaaactaaccgacccaggaaccaaaccgaccccaaatcgatagtactttagtcggacgtactaacgtaacgccggtccctacggtaccggggtccctaggtacttccggtccttcgtcgtcggtcctacgtaagtccgtacggctaaccgccgtcccgtacctcggtaccgttcgtcggtcggtacctaccggagccgtaggagtcggtaggtacggtcttaagttactttacgttacgtacgactacgtcgtaacgtagtacgggtaggacggtacacggtaaccgtacgtttaggttcggtacggtcgggacggacgcgtacgtcgtccggtacncggtacgcgaaccgaccgtacgccctacccgcccgttgtccctaccg

SEQ ID NO: 174619 - DNA, 734 bp, Homo sapiens
  misc_feature: GYAE6OF01BJWMG.22.15.B04.1.454.CMB.1.raw
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
tcagacatacgcgtcacgaccggtgctcgatttagacagtatatatccgcggggggggtctcaggaggcagcgctctcaggacgtcaccaccatggcctgggctctgctccccctcagcctcctcactcagggcacagggtcctgggcccagtctgccctgactcagcctccctccgcgtccgggtctcctggacagtcagtcaccatctcctgcactcggaaccngcagtcgacgttgggtgttaataacgtatcgtctcctggtaccaacaaccaccgaggacaaaccgtacccccaaatcatgtatttagngtacggtacaacgtaacggcgggtcctcggacggggttccctgtaacgtccgtacttccttccgtcggtccgtaccgaacggttcggtacggaccggaacccgaccgggtccccttaccccggtaccggtaccccgttccgtaccggtcgggtacccttcccggagggtcctagggacgggtagtcggtaacgggtcttaggtaattttaccgttacttacgtaccgttaacctactaagtttacgcggagtaaccgggtaccggtacctaaacggtttccgtttgggggttcggttaccggggacggggacggtaaacccgacggtccgttacggtcccggttacggtacggtcgtaccggaccccgaaggtcccgtaccccggaccccgttcggacccttccgttcccgttacccccg

SEQ ID NO: 174620 - DNA, 790 bp, Homo sapiens
  misc_feature: GYAE6OF01BJQ67.22.15.B04.1.454.CMB.1.raw
  modified_base (203)..(203): a, c, t, g, unknown or other
  misc_feature (203)..(203): n is a, c, g, or t
tcagacatacgcgtcacgaccggtgctcgatttagacagtatatatccgcggggggggtctcaggaggcagcgctctcaggacgtcaccaccatggcctgggctctgctcctcctcacgcctcctcactcagggcacgacgggtcctgggcccagtctcgccctgactcacgcctcccgtccgcggtccggtctccgtggacngtcacgtcacctatcctctcgctacgtacggaaccagcgagtcggtacggttggtagttaatactagtcgtctccgtacgtaaccaacaaccgacccgagaccaaaccgaccccaactctatagtaattatacgacgtacaacgtaacggtccgacccgtcgtacgggttcctagtacgtctcgttcgtcgtcgacctacgagtcgtacggtacaaccgccgtccgtccgtacggtacccgttccgtacgtccggtccgtaccggtacggtcggtaggtaacgggtacgttacggtaccggtacgttagtttaaccgttacgtttaccggccgtaacgttaccgtaccgttagtaaacggttcggaacgggacggtacggtaaccgggtaacgttacgttaaacgggttttcgggtacggggttaacccggggacggggttaccgggtaaaccgacgggttacccgggttacccggttacccgggttaacccgggtaacgggtaaccccgacccgggtaacccgggtaaacccggttcccccgtaccccgggttaacccccggtcccggttaccctttacccccggg

SEQ ID NO: 174621 - DNA, 712 bp, Homo sapiens
  misc_feature: GYAE6OF01DWT8K.22.15.B04.1.454.CMB.1.raw
  modified_base (204)..(204): a, c, t, g, unknown or other
  misc_feature (204)..(204): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (657)..(657): a, c, t, g, unknown or other
  misc_feature (657)..(657): n is a, c, g, or t
tcagacatacgcgtcacgaccggtgctcgatttagacagtatatatccgcggggggggtctcaggaggcagcgctctcaggacgtcaccacatggcctgggctctgctcctcctcagcctcctcactcgagggcacgagggtcctgggcccagtctcgccctgactcacgccctccctccggccggtccggtctccgtcggacncgtcagtccacctatcctcgtgacctacgtaggaaccagcaggtcggtacggtttggtacggttaataagttgttcgtcctccgtacggtaaccaaccaactacccggaacgaccaaaccgaccccaatcactagtattagcgtacgtacaacgtacgccgtacctacggtacggtccngtacnccgttacgttccgtacgtccggtactaccgtacgtcgtaacggacctaaccgtcccgtcccgtaccgtaccgtcccgttcgaccggtccggtaccaccggtggtacgtaagggtagtagtcgggagtccgtaagttcttaacgttccgagtccgtatccgtagtagtaggtaccggagaccggtaagtaaccggttagttaacgggttcgggttaccgggtacggggacggaaccgtaccgtacgcggttaccgttaccgtaccggtanacccggaacggcccgtaggtcccccgtaccggaacccgttccgtccgttaacccg

SEQ ID NO: 174622 - DNA, 768 bp, Homo sapiens
  misc_feature: GYAE6OF01EG7K8.22.15.B04.1.454.CMB.1.raw
  modified_base (157)..(157): a, c, t, g, unknown or other
  misc_feature (157)..(157): n is a, c, g, or t
tcagacatacgcgtcacgaccggtgctcgatttagacagtatatatccggcggggggggtctcaggaggcagcgctctcaggacgtcaccaccatggcctggctctgcctcctcctcagccctcctcactcgacggcacgtacggtcctcgggcccngtcctcgtccctgtacctcacctcccttcccgtcccggccggtcccggtcctaccgtcggacacgtccacgtccacctcttccctcctcgtaccaccggtacggaaccagtaccgtaggttcgtacggttaggttacgttaactaacgttcttcgttacctaccgttaaccgtaacccaaactacccgacccgtaacggaacctaaacccgacccctaagtactacggtatttacgtgtacggacgtacgtaccgacggtccctcggtcggtccggtactcgtacgttctcttcgtaccgcgtaaccttctaacgtcgaacgtcccgtaacgtccccgtccgtaccgtaccggtccgttccgtacgggccgttacccgtaggttacggactgggaacgtcggtacgagtacgtttacgttacgtacctcgtacgtacgtcggacccttagtcgtacggggaacgtcgaacccgtggtaaccgttaggttacggtttcgggaacggtcgggtaaccgacggtactaacccgttgggtaccccgtagttacccgccgggtacgtcccgtaccggacgtacccgtccccggttccgtaccgtcgttaaccccgg

SEQ ID NO: 174623 - DNA, 742 bp, Homo sapiens
  misc_feature: GYAE6OF01EF1FO.22.15.B04.1.454.CMB.1.raw
  modified_base (216)..(216): a, c, t, g, unknown or other
  misc_feature (216)..(216): n is a, c, g, or t
  modified_base (524)..(524): a, c, t, g, unknown or other
  misc_feature (524)..(524): n is a, c, g, or t
  modified_base (551)..(551): a, c, t, g, unknown or other
  misc_feature (551)..(551): n is a, c, g, or t
tcagacatacgcgtcacgaccggtgctcgatttagacagtatatatccggcgggggggggtctcaggaggcagcgctctcaggacgtcaccaccatggcctgggctctgctcctcctcacgcctcctcactcgagggcacgacgggtcctcggtcccagtctcgcctgactcacgccctccctccggcgtccgggtctctggacagtcagtccacnctcctccgtcgcacgtacggaacctagactaggtacggtacggttggttacgttaactaacttgttcgttacctaccgtacggtaaaccaaccaaaccgacccgaacggaccaaaaccgaccccctaaactcttagtacgttaatttggtacggtaacggtacgtaaaccgtacgggcccggtccgtacgggttacccgggtcctagacgttccgtcttccggtcgtacggacctacgacgttcgacgtaccgaacgtccgtccctacgtcgtaccgtctacggtcgtacgtcggcgtagacggtcgnggacgtcgtagttacgttactaggtcncgtaacgtctagtacgtacgggtggaaccgtgaacgtacgttacggttaacgggtttgggaccggttccggggaaacgggtctaaacgggtaccgtacggttaccggtccggttaaggtaccgtccgaaaccgggtcccgtaaccgggtcccgttacccgggacccgtttccgtaccgtacggttaccccg

SEQ ID NO: 174624 - DNA, 633 bp, Homo sapiens
  misc_feature: GYAE6OF01CAZG0.22.15.B04.1.454.CMB.1.raw
  modified_base (140)..(140): a, c, t, g, unknown or other
  misc_feature (140)..(140): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (450)..(450): a, c, t, g, unknown or other
  misc_feature (450)..(450): n is a, c, g, or t
  modified_base (487)..(487): a, c, t, g, unknown or other
  misc_feature (487)..(487): n is a, c, g, or t
tcagacatacgcgtcacgaccggtgctcgatttagacagtatatatccggcggggggggtctcaggaggcagcgctctcaggacgtcaccaccatggcctgggctctgctcctctcacgcctcctcactcgagggcacgngggtcctgggcccagtctcgccctgactcacgccctcccgtccggcggtccggtctccgagggacncgtcacgtcacatctcgngcacgtcggaaccagtcagtcgacgttgtagttaanaactgtcgtctaccgtacggtaaccaaacacgaccgacggaaccaaaccgtccccaaatcgactagtacttagngagcctaagacgccgacctcggacgggtcctagacncggtcttacgcgngtaccacgtagtcgcgaacgaaccgaccggtcctaccgtacgaccgtccgtacggttcgaccaccgngcgtaggacgtagtcgacggtacttagattacctagngtacagtcagaacgtgagaccgagagtactaacggttgtttaacggtcgggaccgggtaacgccggttaaaggccggtgtaaccggtaccggtacgtacgaccgacggtacccgaaggtcccgacccgacccgtggtcccttacgg

SEQ ID NO: 174625 - DNA, 760 bp, Homo sapiens
  misc_feature: GYAE6OF01B9J6K.22.15.B04.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcacgcctcctcactcgacgggcacgacgggtcctcgggcccagtctcgccctgactcacgcctccctccgcggtccggtctcgtggacngtcacgtccacctatcctcctgaccacgtacggaaccnggctaggtcggtacggttggtagttaatactagtcgtctcgtacgtaaccaacaccaccgaggaccaaccgaccccaatctatagtacttagcggacgtacctacgtaacggcccggtccgtacgggtacgggtcctacgtacgttccgtctttcgtcgtcggacctacgtaacgtccgacggaacccaaccgtcccgtcccttacccgcgttacccgttcgtccggtccgggaccctaccggacggtaccggtagggtaacggtacgtcggggtacgtacgttaacgttaagtttaaccgtcgtagaccgtacgtccgtagtaacggtgggtacgggaccgtacgaacggttacgttaacggtttgggttcgggtacgggttaaccgggggacggtaaaccgggtaccgtaacggtccggttaaacccgggtccggttaacccgggttaccgtaacccgggtaaccccggtacccggtaacggtccccggtacccccggttccccgggtacccg

SEQ ID NO: 174626 - DNA, 693 bp, Homo sapiens
  misc_feature: GYAE6OF01A2OXT.22.15.B04.1.454.CMB.1.raw
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcagggcacgaggtcctgggcccagtctcgaccctgactcagccctccctccgcgtccgggtctcctggacagtcagtcaccntctccgtgcacgtgaaccagcagtcgacgtttggtagttaactaatatcgtctccgtagtaaccaaccacaccagaccaacncccaaatcactgtaattanaggtacgtacaacgtaacggccgaccctacgaccgggtccctaaggtctacgtccttcgttacgtcggccctacgtaacgtccgtacggaaccaaccgtaccgggtccctacccggtacggacccgttcctcgtacgggaccttacccgaaggtccgtacggaggtagtacgggtacgtcgtaggtaactttacgtactgccgtaacgtctacgtaagtggtaaccggacggtaccgacggtaaccgtaagttaacggttgggttacggtaccggggacgggtaacgtaccggaacgtccggacgttacccgtaacgggtcgttaccgaccgaccccggtacgacccgttaccccgtaccccggtgtaacccgttaccccg

SEQ ID NO: 174627 - DNA, 702 bp, Homo sapiens
  misc_feature: GYAE6OF01CB4LP.22.15.B04.1.454.CMB.1.raw
  modified_base (341)..(341): a, c, t, g, unknown or other
  misc_feature (341)..(341): n is a, c, g, or t
tcagacatacgcgtcacgaccggtgctcgatttagacagtatatatcgggcggggggggtctcaggaggcagcgctctcaggacgtcaccaccatggcctgggctctgctcctcctcagcctcctcactcgagggcacgacgggtcctcggggcccagtctcgccctgacctcacgtccctcccgtccgcggtccgggtctccgtaggacagtcagtcacctatcctcctgcacgtacggaaccagcaggtcgtacggttggtagttaactacgtatcgtctcgtacgtaaccaacaaccaccgacggaccaaaccgaccccaaacgtcatgtaactttanacgacgtacaacgtaacgccgtccgtcgtaccgggtcctagtactccggtcctttcgtcgtcggtacctaccgtaaggtcgacggtaactaaccgcccgtcctcccgtacgtacctcgtcggtacgcccgtacgacggtcgtacgggtaacgtcgtacggtacggtacgttagtttaaccgttaacgttcggttaccgacgttacgtacgtaacttagtacgggtaggaacgtaccacggttacgtacgtttaggtttcgggtaccggttacgggacgtaacggacgtaggtccgtaacggtacccgtacgtacgtccggacgaccggtacgcccgttacccgcccgttggcccttaccgg

SEQ ID NO: 174628 - DNA, 795 bp, Homo sapiens
  misc_feature: GYAE6OF01A5XAA.22.15.B04.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (643)..(643): a, c, t, g, unknown or other
  misc_feature (643)..(643): n is a, c, g, or t
  modified_base (770)..(770): a, c, t, g, unknown or other
  misc_feature (770)..(770): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcacgtcgagggccacgtaggggtcctgggcccaggtctcgccctgactcgacnccgtcccncgcgtccggtctcgtgacntcngtcacctatcctcctgcctacgtcggaaaccngcgtaacggtcggttaacggttcggttaggtttaaactaacttgtcgttccctaccgttaacggaacccaaacctaaccgtaccggaacggaacctaaaacccggaccccctaaacgttacaacgttcgtttaacgttagttaacggggtaacgtacccgtaacggtaaccgggcccggttaaccgcggggttaaccggttccccgtagtacgttcccgtcgttccgtccggttacgcccgtttaacggccggttagtaccggaacaaccgttcccgggcccttaccggtaccgtaccgttccgttccgggacggttccaccggagtccgtaaggcggttacggaggtcgtacgtagtttacgttaacgtacgtactccggtactactacggtaagttacgggnggtaaccggtaaggtccgacgtttaaacggtttggttccgggacgtacggggaccggtagacgaccggtaccggtccggtaacccgttcggtaacgtccgacggtttaacccgaccggtttaccccncccggtttccgccgttcccgtcccg

SEQ ID NO: 174629 - DNA, 647 bp, Homo sapiens
  misc_feature: GYAE6OF01BWW5Y.22.15.B04.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (537)..(537): a, c, t, g, unknown or other
  misc_feature (537)..(537): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtccacatctcctgcactggaaccngcagtgacggttggtagttataactatgtcctccgtcgtaaccaaaccaacacccgaggaccaaaccgacccccaaancgactgtaatttacgtgtaggtacaactaaggcccgtacccgtcggacggggttcccctagtaccgtcgtctttctccgtggcccttaccgaaggttccgtacggacccaaccgtacccgggtacccttccccggtacggtacccgttccgtccggtcgggtcctccgacgggtcgtagaggagtgacggtctaggttatacgttcgngcagtcctanagtgnggtacgngtacgctaacgttagtttcggggacgttcggggacggaacgggaacgtacggtcgtacggtcccgtacgaaggtccgaacgcccggaaggtcccgcccgtccccgttcgg

SEQ ID NO: 174630 - DNA, 645 bp, Homo sapiens
  misc_feature: GYAE6OF01EY2HA.22.15.B04.1.454.CMB.1.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacgagggtcctgggcccagtctcgccctgactcacgcctccctcgcgtccgggtctcgtggacagtcagtccaccatctcctgcacgtcggaaccngcagtgacggttgggttgttactaactntgtctcctgtaaccaacaacaccagaccaaacncccccaaactcatgtactttanaggagtcaacgtacgccggcctacggcgggtccctagtactcggtcctttcgtcgtcgtctacctaagtcgtggaccaacgcccgtcctcccgtcgtacccgttctcgtcgggtcctaccggacggtctagggaacggtatcggaggtctagtatttacgtangacngctactagtacgtcgggaagcgacgtacggactttaaggtttcggtacggttacggggacgggtaacgggtacctacggtaccggttcggtaacccggttccggtaaggtacccgacgtaccccggaggtcccgttcccggtacccccggtcgtacttccccgg

SEQ ID NO: 174631 - DNA, 666 bp, Homo sapiens
  misc_feature: GYAE6OF01DPHWH.22.15.B04.1.454.CMB.1.raw
  modified_base (167)..(167): a, c, t, g, unknown or other
  misc_feature (167)..(167): n is a, c, g, or t
  modified_base (357)..(357): a, c, t, g, unknown or other
  misc_feature (357)..(357): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcngcctccctccggcgtccgggtctcctgggacagtcagtccaccattcctcctagccactaggaaccagtcaggttgacgttggtagttatactatgtctactgtaccacacaccagacaaacgcccaactcatcgtattagtagacggtacacgtagccggcctcgacgggtcctgactcgtcttctcgngctctagtctgcacgccgtcctaccgcgtaccgtctcggcggctcgagtcgtaggagagtggacgtcgtagttactttacgtacgtcgacgacttctacgaagttcggacggggtacgacgtaccgggtaacgtaacggttttaagggttcgggttacgggttaaccgggggtaaccgggtaaccggaaccgggttaaggaccggtttacccgggtaccggtaccggttaacgggacccgttaacggaaccccggtaccggtacccggtacccccgggttccccccgttcggggtaccttaccccccgg

SEQ ID NO: 174632 - DNA, 711 bp, Homo sapiens
  misc_feature: GYAE6OF01D0KRU.22.15.B04.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctcgccctgactcacgccctccctccgcgtcccggtctccgtggacngtcagtccaccatctcctgccactcggaaccngcagtgacgttggtagtatactntgtctccgtagtaccaacaccaccgagaccaaccgaccccaactcatgtatttagtggtaacgtctaacgtacggccggtacccgtcggtaccgggtccctagtactccgtcttcgtcgtcggtcctaccgagttccgtagacctaaccgaccgtccctcccgtacgtccgttccgtacgtcggcctcgacggtcgtaggaggtgtggacggttctagttactttacgtcgtacgtacgcgtcgttaataggttacgtcgggacgtacgtaccggtacgttaacggttttaacggtttcggggtacgggtaccggggtacgggtaaaccgggtaacccgtaaggttccccggttaaccgggtaccccgttacgggttccggaacccgtacccgtaaccccgggtacggttacccccgccccgggttaccccccggttcggtcccttacccccggg

SEQ ID NO: 174633 - DNA, 677 bp, Homo sapiens
  misc_feature: GYAE6OF01B6XM6.22.15.B04.1.454.CMB.1.raw
  modified_base (260)..(260): a, c, t, g, unknown or other
  misc_feature (260)..(260): n is a, c, g, or t
  modified_base (441)..(441): a, c, t, g, unknown or other
  misc_feature (441)..(441): n is a, c, g, or t
tcagacatacgcgtcacgaccggtgctcgatttagacagtatatatccgcgggggctgggggtctcaggaggcagcgctctcaggacgtcaccaccatggcctgggctctgctcctcctcagcctcctcactcagggcacagggtcctgggcccagtctgccctgactcacgccctcctccggcgtccggtctccgtggacagtcagtccaccatctcctgcacgtggaaccagcagtgacggttggtgttaactaactntcgttctccgtacggtaaccaacaaccacccaggaccaaaccgacccccaaatcactgtatttagtagaggtaccaataacggccggtccctacggtcggggtccctagctcgtcttctcgtcgctacgagtcctaggaccaccgcgtaccctccgtacgtcctctcgtcggtcctacggngtacgtggagtacgtggaacggtcttaggtatttagtaccgtgaccgtacgtacctacaagtacggtagggacggtacgtacggtacgtaacgtttacgggttagggttcggtaccggggacggggtaaccggtaacccgtaagggtccctaccgggttaccccggttacgtacccgggtacccggtacgaacccccgtaggggttccccgtccccgggttaaccccccggtcggg

SEQ ID NO: 174634 - DNA, 669 bp, Homo sapiens
  misc_feature: GYAE6OF01AP0PN.22.15.B04.1.454.CMB.1.raw
  modified_base (276)..(276): a, c, t, g, unknown or other
  misc_feature (276)..(276): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (461)..(461): a, c, t, g, unknown or other
  misc_feature (461)..(461): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctcgcccctgacctcacgccctccctccgccggtcccgggtctccgtaggactagtcacgtccacctatcctcctgaccacgtaggaacccagccgtagtgtacgttggtagttataacgtntcgtctccgtacgaccacaaccacctagacaacgaccccaatcatgtattagngacggtaccagtacgccgccncggtacgggtccngtacgtcgtcttctcgtacgcctacgacggtctacggcctaacgcccgtccctcctcggaccgttcgacgtcggtcccgtcgacgtcgagacggtagnggacgtcgttaagtacgtttcgtaagcctacggtacctcgtacgtaagttaggtacgggacgagaccggtaggttaactttacggttgggtaacgggtcgggaacggggtacgaaccgtaaggtccggttaaccgtcggtaccggtacgggtacctaacccgggtacccggcggttacccgtaccggcccccgtttggaaccttcccg

SEQ ID NO: 174635 - DNA, 942 bp, Homo sapiens
  misc_feature: GYAE6OF01E5WE1.22.15.B04.1.454.CMB.1.raw
tcagacatacgcgtcacgaccggtgctcgatttagacagtatatatccggcgggggggggggtctcaggaggcagcgctctcaggacgtcaccaccatcggcctgggctctcgctcctcctcacgcctcctcactcgagggcacgcgggtcctcgggccagtctcgccctgactcacgtccctcccgtccggccgtccggtctccgtaggacagtctacgtccacctatcctccgtcgacctacgtacggaaccagacgtagggttacgtacgggttagggttacgtttaaactaacgttacgttcgttccctaccggttaacggaaacccctaaaaccgaaaccccgacccgaacggaaacccctaaaaccccggtaccccctaaaacttaccgtaagttaacggtttacgttttaacaacgggttaaccgtaccgtaaccgggtaccgggtcccggtacccggttaccgggtccggggttaccctacgttaccgtccggttaccttccggtccggtcgtacctaacggtacgtaccggtcccgaaccgtaacccggcccggttaccccttccggtaaccggtcccgggttaccgtcgggttcccgggtacccggttaccgacgggttacgtacgggacggggttagagggtcgttacgtaaggttactttaacggtcgacgtacgttacgtaccgtaagttaacgtcgggaggtaaccggtagtacccggttaacgggtttaacgttttcgggttaccggggggttaccgggtaacgggaaacccgggttacggaaacccggtacgggtttacccggggtaacccggtaaccggttacggggtacccgggtaaccccggaaccgggtaaccccggttacccggggtacccccggttaccccccggttacccgggtttcccgttaaccccgttcccccggg

SEQ ID NO: 174636 - DNA, 732 bp, Homo sapiens
  misc_feature: GYAE6OF01D32PL.22.15.B04.1.454.CMB.1.raw
  modified_base (174)..(174): a, c, t, g, unknown or other
  misc_feature (174)..(174): n is a, c, g, or t
  modified_base (222)..(222): a, c, t, g, unknown or other
  misc_feature (222)..(222): n is a, c, g, or t
  modified_base (542)..(542): a, c, t, g, unknown or other
  misc_feature (542)..(542): n is a, c, g, or t
tcagacatacgcgtcacgaccggtgctcgatttagacagtatatatccgcggggggggtctcaggaggcagcgctctcaggacgtcaccaccatggcctgggctctgctcctcctcagccctctcactcgaggcacgagggtcctcgggccctagtctcgccctgactacgacnccctacccctcgtcgtcccggtctcgtcggactgtccagtccaacctntcctcctagccacgtacggaacctgctaaggtgtacgttaggttcgttaactaactggtcttccgttacgtaacggtaaccaaaccgaaccaccgaggaacctaaaccggaacccctaaagtcagttacgtaattcgtagtaacggttacaactacggaccgtccgtacggacggtcctaggtctccgtcttccgtctcggtactacgtaacgtcgtcgaactaaccgccggcctacccgtagaccgttctccggtaacggtcctcgtaacggtcgaaggacgtacgtaaggaccgtacgtaattaacgtgtttaaccgngacgaacgtactaagtacgttacgaggtacggtatacccgtaagtttaacgtaggttttcgggacggttacggaaaccgggtacgtaaacccgttaggtacccggtaaccggttacccggttaggaacccggttacgaccctaaccgggtaaccctccggtcccgttaacccggtcgttaacgtcccccg

SEQ ID NO: 174637 - DNA, 784 bp, Homo sapiens
  misc_feature: GYAE6OF01A1QVE.22.15.B04.1.454.CMB.1.raw
  modified_base (200)..(200): a, c, t, g, unknown or other
  misc_feature (200)..(200): n is a, c, g, or t
  modified_base (337)..(337): a, c, t, g, unknown or other
  misc_feature (337)..(337): n is a, c, g, or t
tcagacatacgcgtcacgaccggtgctcgatttagacagtatatatccggcggggggggtctcaggaggcagcgctctcaggacgtcaccaccatggcctgggctctgctcctcctcagccctcctcactcagggcacagggtcctgggcccagtctcgccctagactcacgcctccctcgcgtccgggtctcctggacngtcagtccaccatcctcctgcctactacggaaccagctaaggtgtacgtttcgggtagttaactaacttatggttcctccgttgtaaccaacacgaccaccgagaccaaccgccccagacctctatactatttacgngtctagtacaagtaacggcccgtccccgttacggtaccgggtccctacggtacgtccggtacctttccgttcgtaccggtcctaccgtaacgtccgtacggacctaaccgtccggtaccccttccggtaccgtacctacgttcgtccgtcgggtaccccttaccggtaccggacgttacggaaacggttcggtacggtacggttaccgttaagtttaactttaacggtttaccacggtaccgtacgtacccgttaacgacgtttaacgggtaccggggaacgttaccggacgggttaacgtttaaccgtaaggggtttttccggggtaacgggttccggggaaacccggggtaacgggtaaacccgagggttcccgtacgggtacccccgtttaggtaccgggtaccgaccccgggtaccgtaaccggggtccccgttacccccggg

SEQ ID NO: 174638 - DNA, 876 bp, Homo sapiens
  misc_feature: GYAE6OF01BS2BU.22.15.B04.1.454.CMB.1.raw
tcagacatacgcgtcacgaccggtgctcgatttagacagtatatatccgcgggggggggtctcaggaggcacgcgctctcaggacgtcaccaccatggcctgggctctgctcctcctcacgcctcctcactcgagggcacgtacgggtccgtcgggccctagtctcgccctgactacgacgccctcccgtccggcggtccggtcctccgtgacacgttcacgtaccacctactccgtacctcgaccgaacggtaccggaaccgagtacgtaacggtcggttaaggtttcgggggttacggtttaaaccaaaggttccgttacgttcccgtttaccggtaaccggttaaaccccgaaaccaaccccgtaaccccggacgtaacccgaaccccggtaacccccaaccccccgttaaactaccgtaagtttaacggttaaacttttcgggaacggttaccggtaaacccggtaagggttaaccgggtcccgggtaaccccggttaccggggttacccggggtccccgttaggttacccgttcccgttcccgtttaaccggtccggttccggtaacccttaacccggttaaggtccgtaccggaccggtaccccgtaccccgtacccgttcccggtaccggtccccggtccggtaccgttccgggtaccgttaccgggacggtacggtaggtacggtacggttacggtacggtacgtacgttacgttacttcgtacgttaccgtacgtactaattcgacggcggtacgtaccgtacgttacgtttggtccccgggtaggtcggtaacgggcgaacgtcggaccgtcgacggtacggtctacggcccgaccgtccgccgtacccgtccggtcgtccttccg

SEQ ID NO: 174639 - DNA, 747 bp, Homo sapiens
  misc_feature: GYAE6OF01EZI82.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctcgccctgactcagccctccctccgccgtccgggtctcctggacagtcagtccaccactctcctgcactcggaacctagcctagtgtacgttggttagtttaactaactagttcgtcctcccgtacggtaacccaaaccaaccacccgaacggaccaaaaccgtacccccctaaactaccactagtactttagtacgtacggtactaacgtaaccgcccggtccgttacgaccgggggtccctggtaccgtcgtccttcgttcgtcgtacctaccgtacgtcgtacggaccaaccgtaaccggtcccctacccgtacggacccgttccgtcgtccgggtacctccgtacgggtctaggacggtagtcggtacgtacgttacgtaattttacgtacgtcgacgtacgtctaacgtacgtaggtaggaccgtacgtacggtaccgtaacgttacggttttcgggtaccggttggggaccggtaacgggtaaccaacgggtaccgttacccggtaccggttacccggttacggacccgttacgaccccggtacggtcccgtaccccggtcccccgtttccggtcccgttaaccccg

SEQ ID NO: 174640 - DNA, 722 bp, Homo sapiens
  misc_feature: GYAE6OF01D9B5I.22.15.B04.1.454.CMB.1.raw
  modified_base (180)..(180): a, c, t, g, unknown or other
  misc_feature (180)..(180): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
tcagacatacgcgtcacgaccggtgctcgatttagacagtatatatccggcggggggggtctcaggaggcagcgctctcaggacgtcaccaccatggcctgggctctgctcctcctcacgcctcctcactcgagggcacgagggtcctgggcccagtctcgccctgactcagccctcccncgcggtccggtctccgtggcagtcacgtcaccntcctcctgccacgtggaaccngcgagttggtacgtttggttaggttaaactaacgttagttcgtcctaccgtacggtaaccaaaccaaccaccgacggaacctaaaccgaccccctaaaatctacgttacgttaatttacgacggtacggttacaacggtaacgtcccgggacccgtacggtccggggtacctaggtactccgtcttccgtcgtcggtactactagtcgtcgaaccaccgccggtccctacgtaccgtccgttcgccggtcggtcctacggtacggtcgtagacggtacggtaggacggttttaacggtacttttacgccgtcgacgtacgtacctaacggtagttacggcgggtacgacgtaacgtcgttaaacgttcggtttcgggtacgggccgggtaacggtacggaccgttacggccggtacccgtaaccggttcgtaacgacccgacggtaccggtaccgtccgtaccccggcccggttgtacccttcccggg

SEQ ID NO: 174641 - DNA, 803 bp, Homo sapiens
  misc_feature: GYAE6OF01E1GRM.22.15.B04.1.454.CMB.1.raw
  modified_base (124)..(124): a, c, t, g, unknown or other
  misc_feature (124)..(124): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (475)..(475): a, c, t, g, unknown or other
  misc_feature (475)..(475): n is a, c, g, or t
tcagacatacgcgtcacgaccggtgctcgatttagacagtatatatccgcggggggggtctcaggaggcagcgctctcaggacgtcaccaccatggcctgggctctgctattcctcaccttccncactcagggcacagggtcctggcccagtcctgccctgacccagcctgcctccgtgtctggatcatcgtggacagtccgatcagctactttccngcactgggaccaangtgactgttggttctttgactctcgtctcctggtaaccaacaaccnccgacggaccccaaaccccccatccgatactatttatggtcttcctacgttcccgtccggccgtacacgggtactcctaccttacacttcccgtccgtttacgtccctaaccgggtacttaccccgtaaacgggtacccgttacggaaccccgtaaacccgttaccccggggtaccccttaaaccccggtttaaaccncgtttacccgggttccctaccgggggttacctttaacccggttaacggggtttaccggaaaccggggttaccgttaacgtttaaccgtttaaccgtttacgttacccgttacgtacccgtttaaaccggtttttaacgtttaaacccggttgaaccccgttccgtaaccgttcgtttcggtttaccgggtttacgggccgtaacggtacccgtacggtaaccggtcgtaacccggttccgtacgggtacctaccgggacctaaccgggtcccctaacggtcccccgttacgtcccctacgttccccgttacccgtccccgtaaccccg

SEQ ID NO: 174642 - DNA, 537 bp, Homo sapiens
  misc_feature: GYAE6OF02I6CMQ.22.15.B04.1.454.CMB.1.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagacatacgcgtcacgaccggtgctcgatttagacagtatatatccgcggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggcaaacgccccaaatcatgatttangagtcactagcgccctgagggtcctgatcgcttcnctggctcagtctggcaacncgcctcctcgtctctcggctcacgctcgaggagtgnggtacgtntagttacttacgtgcacgtctctatagtggacggacgaacgtcgacctaagtttcggttgtcggtcgggaggaccgtaacgcgtacggtaccgtaccgtacggtcgacgccgacggtacgtccgtccccgtcgtacg

SEQ ID NO: 174643 - DNA, 516 bp, Homo sapiens
  misc_feature: GYAE6OF02FJPR2.22.15.B04.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaaagccccccaaactcatgatttangaggtcactaagcggccctcaggggtccctgatcgcttcnctggctccaagtctggcaacacggcctccctgacccgtctcgtgggcctccaggctgaggatggaggctgattattactgcagctcatatggagcagcgactaagtttggtgttcggcggagggaccaagctgaccgtctaggtcagcccaaggcctcggcccctggtcaccg

SEQ ID NO: 174644 - DNA, 768 bp, Homo sapiens
  misc_feature: GYAE6OF02HCFBA.22.15.B04.1.454.CMB.1.raw
  modified_base (195)..(195): a, c, t, g, unknown or other
  misc_feature (195)..(195): n is a, c, g, or t
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtcctcgtcgacncgtcacgtccactactcctccgtcgacctacgtacggaaaccacgacgtaggtacggtacggtttgggttaggttaacttaaacttagttcgttccttccggttacggtaaacccaaaccaacccaccgacgaacaaacccgaaccccctaaactactagtacgttaactttagtacggtacgtacctaaacgtaacggcccggtccctacgggtaccgggtcctagtacgtccgtcttcctcgtcggtcctacgtaacgttcgtacggaaccaaaccggtccggtcccttccgtacggtacccgttcttccgggtcgggtccctaccgggacggtcgtacgggaacggtagtgggacggtcgtagttaactttaacgttacgtcgacgacgtcctacgtaagttaggtaggggacgacgacggaccgtaacgtttaacggtttcgggttcggttacgggacggggaaccggaccgtaaggtccggtaaccggtacccggttacggtaacggtacgaacccggacccggtaacggtcccgtaccccggtcccccggttacggtacctacccgg

SEQ ID NO: 174645 - DNA, 527 bp, Homo sapiens
  misc_feature: GYAE6OF02GUR3O.22.15.B04.1.454.CMB.1.raw
  modified_base (300)..(300): a, c, t, g, unknown or other
  misc_feature (300)..(300): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagctccctccgcgtccgggtctcctggacagtcagtcaccatctcctgcactggaaccagcagtgacgttggtggttataactatgtctcctggtaccaacaacacccaggcaaagcccccaaatcatgatttangaggtcactaagcgggcctcgacggggtccctgatcgcttctctggctccagtctggcacacggcctccctgaccgtctcgtcgggctccgaggctgaggatgaggctgtattattactgtctactcatatgcgaggcgactaacgttcgttgggtgttcggcgggacgggaccagcgtcggccgtcgtacggtcacgccgaggcctccgccccgtcgtccactccg

SEQ ID NO: 174646 - DNA, 553 bp, Homo sapiens
  misc_feature: GYAE6OF02HXP1U.22.15.B04.1.454.CMB.1.raw
  modified_base (297)..(297): a, c, t, g, unknown or other
  misc_feature (297)..(297): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccagcagtgacgttggtgttataactatgtctcctgtaccaacaacaccaggcaaagcccccaaactcatgatttangaggtcactaagcggccctcgagggtccctgatcgcttctctgctccaagtctggcaaacgcggcctccctgacccgtctcgtgggcctccgaggctgaggatgaggctgatttattactgcagctcaattagtggagcagcgtaactaagttttgggagttcggcgggtaacgggaccaaggccgtggacccggttcgtaacggtccgacgaccccgaagggtccctaccggcccccgttcgggtacctacccgg

SEQ ID NO: 174647 - DNA, 618 bp, Homo sapiens
  misc_feature: GYAE6OF02G91PP.22.15.B04.1.454.CMB.1.raw
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccaactcatcatttanggtgtcactcgtcggccctcaggagtctctcatcgcttctcaggctcaagtctgcaacncggcctccctaacatctctggctccagtttgaggacgagtctacttattactgctagtttcctttaaattacggccgtacctaccttccgttacggtttcgggtttttccgggacgggtacggtccgaaccggtaaggttcggtaacccggttcccgttccgggttacccaacggtcccccgtaaagggtccccgttaccggtcccccccgttaccgggttcccctaacccgtttcccgttacccggtttcccccccgg

SEQ ID NO: 174648 - DNA, 564 bp, Homo sapiens
  misc_feature: GYAE6OF02IVVC9.22.15.B04.1.454.CMB.1.raw
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggcaaacgcccccaaatcatgatttatgaggtcactaagcggccctcgacggggtccctgatcgcttctctggctccaagtctggcaacacggccctcctgaccgtctcgtgggcctccaggctgaggntggaggctgatttatactgcagctnatagtggaggcagcgtaactagttttggtgttccgggacgggtaacgggaccgtaacggtccgtacggtacccggtccgttaacgggtccacggccccgaagggtcccgtaccggccccccgttcggtccctacccg

SEQ ID NO: 174649 - DNA, 566 bp, Homo sapiens
  misc_feature: GYAE6OF02IKJVG.22.15.B04.1.454.CMB.1.raw
  modified_base (304)..(304): a, c, t, g, unknown or other
  misc_feature (304)..(304): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactgaaccagcagtgacgttggtgttataactatgtctcctggtaccaacaacacccaggcaaacgccccaaactcatgtatttangaggtcactaagccggccctgacgggtccctgactcgcttctctggcctcaagtctggcaacgccggcctccctgacccgtctcgtgggcctccgaggctggaggatggaggctgtatttacttactgctagctacagtagtgggagcagcgaactagtttcgggtcgttacgggcgggtaacgggacccgaaggtccgtacggtacccgttcgtagggtccacggtaccccgaaggtcccttacccggcccccgttacggg

SEQ ID NO: 174650 - DNA, 673 bp, Homo sapiens
  misc_feature: GYAE6OF02ILDO2.22.15.B04.1.454.CMB.1.raw
  modified_base (325)..(325): a, c, t, g, unknown or other
  misc_feature (325)..(325): n is a, c, g, or t
  modified_base (492)..(492): a, c, t, g, unknown or other
  misc_feature (492)..(492): n is a, c, g, or t
tcagacatacgcgtcacgaccggtgctcgatttagacagtatatatccgcgggggctggggtctcaggaggcagcgctctcaggacgtcaccaccatggcctgggctctgcctcctcctcagccctcctcactcgagggcacgacgggtcctcgggcccagtctcgccctgactcacgccctccctccgcgtccgggtctccgtggacagtcagtccaccatctcctgcactggaaccagcagtgacgttggtgttaataactatgtctccgtggtaaccaacaaccacccaggacaaaccgaccccaaaatcatagtatttagngtacggtcaacgtaacgccgtccctgacgggtcctagactcgtcttctcgtcgccttaccgagtcgtacgaccaacgaccggtccctcccgtacggcccgttctcggtcgggtcctcccgaggtcgtaggaggtactcgggacggcgttagttaatttacgttacgngtcctacgacctctaagttacgtagggacggtccgaggtaccgtaacgttaaggttttcgggtacgggttacggggacggggtacggtaacggtaacggtccggttacggtacccggttaccggttaacggtaccgaccggtacccgtaacgggtcccttccccgggtaccccgttaccgg

SEQ ID NO: 174651 - DNA, 603 bp, Homo sapiens
  misc_feature: GYAE6OF02GZWF4.22.15.B04.1.454.CMB.1.raw
  modified_base (223)..(223): a, c, t, g, unknown or other
  misc_feature (223)..(223): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctctgcactggaaccngcagtgacgttggtgttacaagtatgtctcctgtaccaacaccaccaggcacacgaccccaaactcaatgatttatgaggtcaactaagcgggcctcgacgggtccctgatcgcttctctggctcaagtctggcgacgacggcctccgtcgaccgtctcgtcgggcctccgaggtcgtggaggtatggaggtcgtagtatttattactgtctcgtctactagtttgaccgacggtccgtccgttaacgtacgtttggggtcgttccggggaccgggtaacgggacctaaggtccgtacggtaacccggttaccgttaacggtaccgacggaccccggtaacggtcccgtacccggtcccccgttacggtacccttacccg

SEQ ID NO: 174652 - DNA, 563 bp, Homo sapiens
  misc_feature: GYAE6OF02I49BC.22.15.B04.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactatgtctcctggtaccaacaacaccaggacaaacgcccccaaactcatgatttangaggtcactaagccgccctcgacggggtccctgactcgcttctctgctccagtctggcacacgcctccngacctctcgtcggcctccgaggctggaggatggacggtctagtatttattactgcagctcattagnggacgcagcgtaattagtttggtacgttcgggacgggacgggaccgaaggtccgtcggacccggttcgtacggtaccacggtaccccgaagggtcccgtcccggacccccgttggtaccctacccg

SEQ ID NO: 174653 - DNA, 620 bp, Homo sapiens
  misc_feature: GYAE6OF02ISBUQ.22.15.B04.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacaggatcctgggctcagtctgccctgactcagcctcgctcagtgtccgggtctcctggacagtcagtcaccatctcctacactggaaccngcagtgatggttggtagttataactatgtctctgtacaacagcaccaggacaaacgccccagactcaatctattacngctagtacaagtaacgccgcctgacgggtccctgactcgtctttcncgtcggcctcgaagtcctcggaccaaccgtccggccctcccgtagaacccacttccgtacggtcgggtccttaccgacggtcctaaggtaacgtacgtcggacggttcgtagtaacgttttacttaccggttcgtccgtacggtccttacgttaactttcggaccgtaacgcccgttacctacgttacggtttcggggttacgtccggggacgggttaacggaaccgtagtccggtaccggtaccggtaccggtacggccgtacgaccccgg

SEQ ID NO: 174654 - DNA, 677 bp, Homo sapiens
  misc_feature: GYAE6OF02IB9YS.22.15.B04.1.454.CMB.1.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (417)..(417): a, c, t, g, unknown or other
  misc_feature (417)..(417): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttataactntgtctctgtaccacaacnccaggacaacgccccaaatcatatatttangacgtacactaacgcgcctcgacgggtccctgactcgtcttctcgtcggctaccgagtcctggacaacgccggcctcctcgacccgtctcgtcgggtcctccgaggtccttaggaagggtnttacgggacggtaccgttaaggttacgtttaacgtttacccgtcgtaccgtaacggttccttacggtaattacgggtcgggaacgggtctaaccgggtccgttaaaccgttaacgtttttcgggggttcggttaccggggtacgggaaccgggtaccgtaacgggtccgtacgggtaaccccggttacggttaaccgggttaccaccgggtacccaagggtccccgttccgggtacccccgtttcggtacccttacccgg

SEQ ID NO: 174655 - DNA, 675 bp, Homo sapiens
  misc_feature: GYAE6OF02JRAGZ.22.15.B04.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
tcagacatacgcgtcacgaccggtgctcgatttagacagtatatatccgcgggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctggtaaccaanaacacccgaggcaaacgcccccaaatcatagtatttanggagtcaacgtaacgcggtccctacgacggggttccctgacgtcgtctttcctcgtcggcctaccgtaagtcgttcggacctaaccgccggcccttccctggacccgttctccgtgggcccttacgaggccttgggacggtactggacggtcttaggtattacgttgtaccgctacgtcgttacctaagttacgtacgggacggtacgtaagggtaaccggtaacctttaaagggttttttggggcggtttacccggggtaccgggtacgggaacccgtaacgttccgggtcggtaaaccccgggtttcgaaacgggttccgaaaccggcccgtaagggcccgttacccgcccccgttacggtaccctccg

SEQ ID NO: 174656 - DNA, 621 bp, Homo sapiens
  misc_feature: GYAE6OF02IGWNY.22.15.B04.1.454.CMB.1.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctcctgcactggaaccngcagtgacgttggtggttataactntgtctctgtaccaacaacaccagcaacgccccaactcatgattatgagtcactaagcggccctcgacggggtcctgactcgtcttctctcggctaccgaagtcgtcggacaaccgaccggtcctccctgtacccgtctcgtcgggcctcgacggctcggaggtagtgacggtaccttggtaactttacgtttctacggaccctacgttccttagtacgtaaccaacgtacggccgtttggggtccgtccggttacggttacgtcgggaccggggtaacgggaccaggcgttcggaaccccggttccgttacgggtccgaccggacccgtaggtcccgtcccggacccccgttcggttacccgacctttccgg

SEQ ID NO: 174657 - DNA, 586 bp, Homo sapiens
  misc_feature: GYAE6OF02I8BV1.22.15.B04.1.454.CMB.1.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
  modified_base (404)..(404): a, c, t, g, unknown or other
  misc_feature (404)..(404): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactatgtctcctggtaccaacaacacccaggcaaagcccccaaatcatgatttangaggtcactaagcggccctgagggtccctgatcgcttcncgtggctccagtctggacaacgcggcctccctgacccgtctcgtcgggctccgaggctaggaggntggagctgatttataacgtgactacgcttcattgagggaggcacgcgtaactaagttttcgggtagttccgggacggggtaacggacccgtaaggtccgtacggtaacccgttccgtaagggttaccgaccgtaccccgaagggtcccttacccggacccccccgttgggtccctaacccgg

SEQ ID NO: 174658 - DNA, 819 bp, Homo sapiens
  misc_feature: GYAE6OF02FZIBH.22.15.B04.1.454.CMB.1.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagacatacgcgtcacgaccggtgctcgatttagacagtatatatccggcgggggggtctcaggaggcaggcgcctctccagggacgttcaccgacctatggtccgtgggctctggctcctacctcagcctacctcactcagggctacgaggtcctgggcccaggtctttgccctggactctaaggcctccctcgcgtccgggtctccgtggacagtcagtcaccaggtctccttggccacgtcggaaccggcgcgagtcgacgttcggtggttanactagtcgtctcgtggtaccaactaacnccaggcaaacgccccaaactcatcgtagttacgcgaggtcacgtaaggcggccctggacggggttccctgtacgtcgtactttacgtcgtacgggtcgttaccgtaaagttccgtaacggtaccaaaccgtaccgggtccccttaccccggtacgggtaacccggttcccgttccggttaccggggacccttacccggtacgggtcctagggaaacggtacgttacggtaaccgggtacgttacggaacttttaacgtttaaccgtggttaccttacgtaccttacgtaaacgttttcggaaccgtacgggtcccgttaccgtaaccgttaccgggtttccggggttacggttacccgggaaccggggtaacccggttaaccgttacggttacgttaccgggtaacccggttaacccgttaacgggtaccggtaacggggtaacccggtaacgggggtcccttaacccgggttcccccccggttcggggtttacccttacccggtttaccccgg

SEQ ID NO: 174659 - DNA, 726 bp, Homo sapiens
  misc_feature: GYAE6OF02JFLDX.22.15.B04.1.454.CMB.1.raw
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtagttaataactatgtctcctgtaccaacaaccacccaggacaaacgcccccaaactcatacgtatttatgacggtacaacgtaacgccggccctacgacggggtccctgactccgtcttcgtcgtcggcctaccaagttccgttaggaccaacgaccggtccctccccgtacgtacccgttcctccggtacgggccctaccgtacgggcgttacggaacggtacgttaggaacgggtctacgtaaacttttcgttaaccgtgaccgtacgtccttaacgacgttaacgtgaccgtacgggtaccgtaaccgttaaccgtttcgggtttcgggggttaccggttaccggggaacggggttaaccgggaacctaaacggtcccggttaacggtaacccggttaccggttaaccggtccgaaaccgggttaccccggaacgggttcccccgttacccgggacccccccggttttacggacccgttaaccccg

SEQ ID NO: 174660 - DNA, 557 bp, Homo sapiens
  misc_feature: GYAE6OF02IE6WC.22.15.B04.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttataactntgtctctgtaccaacaacaccaggctaaacgccccaaatcatcgatttangaggtcactaagcgccctgacgggtcctgactcgcttcgtctcggctccgaagtcgtaggccaacgccgtccctcctcgtaccgtctcgtcggctccgaggctgagtngagctagatttatctgcacgtntacattagagggagcgagacgtacttaaggtttggtaggtccggacgggtacggactacggcgtcggaccgttccgtacggtacgaccgtaccgaggtccgtacccgaccccggttcggtaccctaccg

SEQ ID NO: 174661 - DNA, 562 bp, Homo sapiens
  misc_feature: GYAE6OF02F2S9B.22.15.B04.1.454.CMB.1.raw
  modified_base (303)..(303): a, c, t, g, unknown or other
  misc_feature (303)..(303): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacaccaggacaaacgcccccaaactcatgatttangacgtcactaagccgccctcgacgggtcctgactcgcttctcgtgctcaagtctgcacacggcctccctgaccgtctcgtcggctccgaggctgaggatggaggctggatttactactgcagtctactatagtgggacgcgaaggcgaacgttaagttcggtggttaccgggacgggagggaccaaggcgtacggtaccgtccgtaacggtcgaaccggacccgaacgggtccttacccggccccgttggtcctacccg

SEQ ID NO: 174662 - DNA, 638 bp, Homo sapiens
  misc_feature: GYAE6OF02HMQ64.22.15.B04.1.454.CMB.1.raw
  modified_base (406)..(406): a, c, t, g, unknown or other
  misc_feature (406)..(406): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggcaaacgcccccaaactcatgatttatgagtacactaagccgccctgacgggtcctgatcgcttctctggctcaagtctggcaacgaccgccctccgtgacccgttctcgtgggcctcccaggtctggacggntggacggctagtaattacgttacgtgtacagtcctacgtattacgtcgggaacggcgtacgggaccgaacgtttaagttttcggggttacggtttccggggacgggtacggggacccgtaaaggtcccggttaacgggtaccccggttaccggttaacgggtacccgaaccggtccccgtaaacgggtccccgttacccgggcccccccgtttagggtccccttaaccccgg

SEQ ID NO: 174663 - DNA, 557 bp, Homo sapiens
  misc_feature: GYAE6OF02I8B4D.22.15.B04.1.454.CMB.1.raw
  modified_base (343)..(343): a, c, t, g, unknown or other
  misc_feature (343)..(343): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggcaaacgcccccaaactcatgattatgaggtcactaagcggccctcgacggggtccctgatcgcttcnctgctccaagtctgcacacgcctcctcgaccgtctctgggcctccgaggctggaggatggagctgatttattactgcagctacatagtggacgcagcgtaactaatttgggtcgttacgggacggagggacccaagtccgtacggtacccgttaccgtaggtacgaccgtacccgaaggtcccgttaccgcccccggttacggtaccctacccg

SEQ ID NO: 174664 - DNA, 563 bp, Homo sapiens
  misc_feature: GYAE6OF02GA3TO.22.15.B04.1.454.CMB.1.raw
  modified_base (303)..(303): a, c, t, g, unknown or other
  misc_feature (303)..(303): n is a, c, g, or t
  modified_base (420)..(420): a, c, t, g, unknown or other
  misc_feature (420)..(420): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacaccaggacaaacgcccccaaactcatgatttangagtcactaagcgccctcgacggggtccctgactcgtcttctcgtggtcctaccgaagtctcggacaacgacggtccctcccgtcgacccgtctcgtcggcctcgacggctgacggntggacggctgtattattacgtgcacgtctacatagtggagtcagtcgaacttaagtttggcggttcggacggaggaccaggtcgtcggaccgttccgtacggtccacgcccgaacggcctccggaccccgttggtacctaccg

SEQ ID NO: 174665 - DNA, 539 bp, Homo sapiens
  misc_feature: GYAE6OF02FHVI3.22.15.B04.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (403)..(403): a, c, t, g, unknown or other
  misc_feature (403)..(403): n is a, c, g, or t
  modified_base (428)..(428): a, c, t, g, unknown or other
  misc_feature (428)..(428): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactntgtctcctgtaccacacacccagcaaacgcccccaaatcatgattangagtcactaagcgccctgagggtcccngactcgcttcnctggctccaagtcaggcaacgaccggtccctcccgtgacccgtctcgtcgggctccgaggctggagtangaggtctagattattactgcagctnatagtggagtcagcaataagttgtggttcgggcggacggaccaaggtccgtacgtaccgtccgtaaggtccacgacccgaagggcctcccggcccccgttggtacctaccg

SEQ ID NO: 174666 - DNA, 531 bp, Homo sapiens
  misc_feature: GYAE6OF02FMM1Q.22.15.B04.1.454.CMB.1.raw
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (389)..(389): a, c, t, g, unknown or other
  misc_feature (389)..(389): n is a, c, g, or t
  modified_base (426)..(426): a, c, t, g, unknown or other
  misc_feature (426)..(426): n is a, c, g, or t
  modified_base (513)..(513): a, c, t, g, unknown or other
  misc_feature (513)..(513): n is a, c, g, or t
tcagacatacgcgtcacgaccggtgctcgatttagacagtatatatccgcggggggggtcgtcgaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacccagcagtgacgttggtggttataactatgtctcctggtaccaacaacacccaggcaaagccccccaaactcatgatttangaggtcactaagcggccctcaggggtcccngactcgcttctctggctccaagtctggcaacacggcctccctgacccgtctcncgggctccgaggctggaggatgagctgatttattacngtcagctcatatggaggcagcgactaatttcgggtgttcgggcggagggccaaggcgtgacccgtcttaggtcagcccaagggtccncggcccccgtggcctacg

SEQ ID NO: 174667 - DNA, 668 bp, Homo sapiens
  misc_feature: GYAE6OF02HZC82.22.15.B04.1.454.CMB.1.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttanaactntgtctctgtaccaacaacacccagacaaacgcccccaaatcatacgatttacngagtcactaagcgccctgacgggtccctgactcgtcttcgtcgtggtctaccgagtcctacggacctaaaccgaccggtcccttcccgtacggtacccgttctccgtacggggtacccttacccggagggtcccgttagggaacggtagtacgggaacggtcgttacgtaactttaacgttaacgttcggactacggtcctacgtagtaacgtacgggacggacgtacggaaccgtaacttaaggtttgggtacgttaccggggacggtaacgggtaccaacgggtccgtaacggtacccggttacgtacggtaccgaccggacccgtacggtcccgttcccggtaccccgttcggtacctaacccg

SEQ ID NO: 174668 - DNA, 521 bp, Homo sapiens
  misc_feature: GYAE6OF02JAIY1.22.15.B04.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactntgtctcctggtaccaacaacacccaggcaaacgcccccaaatcatgattngagtcactaagcgcctcgacgggtccctgactcgcttcntgctcagtctgcacncgcctccngacctctctggctccgagctgagtngagctgattattacngcagctacattacgnggacgcagtccgaacttagtttgggtagttcgggacgtacggaccaaggcgtacggacccgtgtaacggcacgaccgtacgccgtacccgccccgttggcctaccg

SEQ ID NO: 174669 - DNA, 550 bp, Homo sapiens
  misc_feature: GYAE6OF02HUCKJ.22.15.B04.1.454.CMB.1.raw
  modified_base (372)..(372): a, c, t, g, unknown or other
  misc_feature (372)..(372): n is a, c, g, or t
  modified_base (469)..(469): a, c, t, g, unknown or other
  misc_feature (469)..(469): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcaagtgacgttggtgttataactatgtctctggtaccaacaacacccaggacaaacgccccccaaatcatgatttatgaggtcactaagcgccctcgacgggtccctgatcgcttctctggctcaagtctggcaacgcgcctcccngaccgtctctggctcgaggcctgaggatgagctgatttaattactgcagtctcatagtaggacggcaagcgactaagtttggtagttcggtacgggnggaccgaagtccgtacgacccgttcgtaacggtaccacggtacccaacggtccgtaccgtccccccgttggtccctacccg

SEQ ID NO: 174670 - DNA, 825 bp, Homo sapiens
  misc_feature: GYAE6OF02GAKQC.22.15.B04.1.454.CMB.1.raw
  modified_base (280)..(280): a, c, t, g, unknown or other
  misc_feature (280)..(280): n is a, c, g, or t
  modified_base (571)..(571): a, c, t, g, unknown or other
  misc_feature (571)..(571): n is a, c, g, or t
tcagacatacgcgtcacgaccggtgctcgatttagacagtatatatccggcgggggggtctcacggaggcagcgctcgtcaggtacgtcaccaccatggcctgggctctgctcctcctcagccctcctcgacttcgagggcacgacgggttccgttcgggcccctaggtctgtaccctggactcagtcctccctcgcgtccggtctccgtggacagtcggagtcaccatcctccgtgccacgtggaaccagccagtgaccgttggtcggttaataacgtnttcgtctcctaggtaaccaacgaacaccgagacaaacgcccccaaactcactcgatttacgaggtacggtcacgtaacggccggtcccgtgacggggttccccttggacttccgtcgtttacgtacgtcgggtaccttaccgtaaacgttccgtacgggacctaaaccggtacccgggtacccgttacccccggtacggtaaccccgtttccgtacccgtacggggtcccttacccggaacgggtctacggaacgggtctaagggaccggtacttagtaactttagttacngaccgtagactaacctagttaacggtagggaacggtacgacggtaccggtaacgtttaaaggtttttcgggttaacggtttaccgggaccggggtaaacgggtaaccggtaaaggggttaccccgtacgggttaaaccccggttaccgggttaaaccggggttacctaaaccccgggtaaccccggtaaaagggttttcccccgttccccggtttacccccccgggtttacgggttaccccgttaaccccgggg

SEQ ID NO: 174671 - DNA, 540 bp, Homo sapiens
  misc_feature: GYAE6OF02H6I3Q.22.15.B04.1.454.CMB.1.raw
  modified_base (224)..(224): a, c, t, g, unknown or other
  misc_feature (224)..(224): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccngcagtgacgttggtgttataactatgtctcctgtaccaacaacacccaggacaaacgcccccaaactcatgtattatgaggtcactaagccggcctcgacgggtccctgactcgtcttctctggctccaagtctgcaacgaccggcctcccgtcgaccgtctcgtcgggcctccgaggctggagntgnggctgatttattctgcacgctcaagtatgggagcgagtcgaatagtttggcggttcggacggtaggacctaggccgtcgaccgttcgtacgtccacgccgacggcctcccggtccccgtcggactccg

SEQ ID NO: 174672 - DNA, 202 bp, Homo sapiens
  misc_feature: GYAE6OF02ITFD8.22.15.B04.1.454.CMB.1.raw
  modified_base (197)..(202): a, c, t, g, unknown or other
  misc_feature (197)..(202): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggactnnnnnn

SEQ ID NO: 174673 - DNA, 531 bp, Homo sapiens
  misc_feature: GYAE6OF02G94W8.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacaccaggcaaacgcccccaaactcatgattatgaggtcactaagccggccctcgacggggtccctgatcgcttctcgtgctccaagtctggcaacgacgccctccctgacccgtctcgtgggcctccgacggctggaggtatggacggtctagtatttacttacgtgacagtctcatagtggagcagcgacttagttggtggttacggcggaggaccagcgtgacctcgtagtcacgccgacggcctccgcccctgctaccg

SEQ ID NO: 174674 - DNA, 548 bp, Homo sapiens
  misc_feature: GYAE6OF02IO42D.22.15.B04.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (346)..(346): a, c, t, g, unknown or other
  misc_feature (346)..(346): n is a, c, g, or t
  modified_base (448)..(448): a, c, t, g, unknown or other
  misc_feature (448)..(448): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacngtcagtcacatctctgcactgaaccngcagtgacgttggngttanaactntgtctctgtaccaacaacaccaggcaagcccccaaatcatgatttatgaggtcactaagccgccctgacgggtcctgatcgtcttctctgctcagtctgcacncgcctcctgaccgtctcgtcgggctccgaggtctggacgatggacggtctagtatttacgttacgtgcagtctacatagtggagcagcgtaatagttttggngttacgggacggtaggacctaaggtccgtcggtaacccgtccgtaacggtaccgaacgaccccgtaaggccttacccggcccccgttcggtacctacccg

SEQ ID NO: 174675 - DNA, 615 bp, Homo sapiens
  misc_feature: GYAE6OF02GQA1X.22.15.B04.1.454.CMB.1.raw
  modified_base (225)..(225): a, c, t, g, unknown or other
  misc_feature (225)..(225): n is a, c, g, or t
  modified_base (410)..(410): a, c, t, g, unknown or other
  misc_feature (410)..(410): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactatgtctcctggtaccaacaacaccaggacaaacgccccaaactcatgatttatgaggtcacgtaagccggccctcgacgggtccctgactcgtcttctctggctaccgaagttctggacaaccgaccggtccctcccgtcgtacccgtctcgtggcctccgnggtctggaggtatggagtcgtagtattattacgtcgtacacgtctacagttagtcggaggacgtacggaccgtaacgttaaggttttcgggtacggttcgggacgggaacgggacccgtaaggtccgtacggtaacccggttcgtaacggtaccgaacggtacccgaacggtccgtccccggtcccccgttcggtccttacccgg

SEQ ID NO: 174676 - DNA, 516 bp, Homo sapiens
  misc_feature: GYAE6OF02F9CUE.22.15.B04.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaatcatgatttangaggtcactaagcggccctnaggggtccctgatcgcttctctggctcaagtctggcaacncggcctccctgacccgtctcgtgggctccgaggctgaggatgagctgattattactgcagctcatanggagcagcgataagtttggngttcggcggaggaccaaggctggaccgtcgtaggtcacgcccaaggcctcgcccccgttggtctaccg

SEQ ID NO: 174677 - DNA, 597 bp, Homo sapiens
  misc_feature: GYAE6OF02F4358.22.15.B04.1.454.CMB.1.raw
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaacgcccccaaatcatgatttangaggtcactaagccggccctcgacggggtccctgtactcgtcttctcgtggcctccaagtcctggccaacgacggccctccctggacccgtctcgtcggcctccgaggctaggagngtggacggtctagtattattacgngacagcctanatagtggacggctaggcgtaacttaagtttcgggacggttccgggacgggaacgggtaccaaggtccgtacggacccggttacgtacggtaccgaccggaccccgtaagggcccttacccggcccccgttacggtccctacccgg

SEQ ID NO: 174678 - DNA, 641 bp, Homo sapiens
  misc_feature: GYAE6OF02H6AXW.22.15.B04.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaccagcagtgacgttggtgttataactntgtctctgtaccaacaacaccagacaaacgccccaatcatntattangagtacactagcgcctgacgggtcctgactcgcttcncgtgacctacgaagtcgtacgacaacgtccggtacccttccgtcgtacccgttcgtccgtcgggtcctcccgtaggtccgtaggaggtattcggacggtcgtggtaactttacgttaccgtgacgacgtctacgatagttacgggacgactacggacgtaacgttaagttttcgggtagttaccgggacgggtaacggaacccgtaaggtcccgttacgggtaaccccgttaccgtacgggttaccgaacggtaccccggtaaccggtcccgtaaccccgggtcccccgttacgggtaccctaacccgg

SEQ ID NO: 174679 - DNA, 644 bp, Homo sapiens
  misc_feature: GYAE6OF02J0ZH8.22.15.B04.1.454.CMB.1.raw
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
tcagacatacgcgtcacgaccggtgctcgatttagacagtatatatccgcggggggggtctcaggaggcagcgctctcaggacgtcaccaccatggcctgggctctgctattcctcaccttcctcactcagggcacagggccctgggcccagtctgccctgacccagcctgcctccgtgtctggatcatctggacagtcgatcagcatttccngcactgggaccaacagtgacagttgggttcttttgactctgtctctgtacaacacaccagaccaacccccatcatcattatgtntcactcgtcgcctcgaggtatctcnctactcgtcttcctcgacgcctaccgaagttctcggaccaacgtacccggcccttacccctaactactccgtcgtacgggtcccttaccgtaggtttacgacgggtaaccgtacgtttacctaactttacgttaactcgtacttacgtttaacttttaaacgttacggccttacctaacgttccgttcgggttttcggtttcgggaccgggtacgtccgtaaccgtaagttccgacccgttcgtaccggtactaccgtccgaacggttcctcccggtccccgttacggtacctaccgtttcccgtccgttaccccgtacccc

SEQ ID NO: 174680 - DNA, 552 bp, Homo sapiens
  misc_feature: GYAE6OF02G1ZAF.22.15.B04.1.454.CMB.1.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (407)..(407): a, c, t, g, unknown or other
  misc_feature (407)..(407): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactatgtctcctgtaccaacaacaccagcaaacgccccaactcatgatttangaggtcactaagccggccctcgacgggtcccngactcgtcttctcgtgcctcaacgtctggacaacgaccggccctcccgtacgccgtctcgtgggcctcgagctggagntgagctgattattactgctagctcatagtggacggcgactaacgttcgttgggtcgttcgggcgggacgaccagtccgtcggaccgtccgttaggtccacggtacccgagggtcctccggtccccggttcggtcctacgttcccg

SEQ ID NO: 174681 - DNA, 560 bp, Homo sapiens
  misc_feature: GYAE6OF02GI0KT.22.15.B04.1.454.CMB.1.raw
  modified_base (303)..(303): a, c, t, g, unknown or other
  misc_feature (303)..(303): n is a, c, g, or t
tcagacatacgcgtcacgaccggtgctcgatttagacagtatatatccgcggggggggtctcaagaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactggaaccagcagtgacgttggtgttacaagtatgtctcctggtaccaacaccacccaggcacacgcccccaaactcatgatttangagtcactaagcggcctcgaggggtccctgactcgcttctctggcctccaagtctggcgaccgacggccctcccgtgacccgtctcgtcgggcctcccgaggtcctggaggatggaggtctagatttattactgacttactcattactgcgaggcgtactaacgttcgttgggtcgttcgggacggtacgggacagcgtcggacccgttcgtaggtcacggacccgaaggcctccggcccccgttcggtcctacccg

SEQ ID NO: 174682 - DNA, 638 bp, Homo sapiens
  misc_feature: GYAE6OF02IZV1M.22.15.B04.1.454.CMB.1.raw
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacacgtcagtccaccatctcctgcactggaaccngcagtgacgttggtgttataactatgtctctgtaccaacaacaccnggacaacgccccaacncatgtattangtagtcactaacgcgtccncgacggtcctgactcgcttctctgctacagtcacggacaacgaccgtcctacctcgaccgtctcgtcggcctcgaggctggacgtcgaggacgtcgtacgtaatttacgtacgtcgcgtaactcgtctaagttcggtaacggcggacgacggttaaccgtaattaaggtttttccggggtaacggtttcccgggaacggggttaccgggaaacccgaacggttcccgggtacccggtttaaccggaccggtttaaccggtcccgaacggtacccggaccggttacccgtcccggtacccccgttcggtaacccgttccgg

SEQ ID NO: 174683 - DNA, 648 bp, Homo sapiens
  misc_feature: GYAE6OF02HUP5W.22.15.B04.1.454.CMB.1.raw
  modified_base (227)..(227): a, c, t, g, unknown or other
  misc_feature (227)..(227): n is a, c, g, or t
  modified_base (302)..(302): a, c, t, g, unknown or other
  misc_feature (302)..(302): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctctcactcagggcacagggtcctgggcccagtctgccctgactcagcctccctccgcgtccgggtctcctggacagtcagtcaccatctcctgcactggaaccngcagtgacgttggtgttatactatgtctctggtaccaacaacaccaggacaaacgaccccaaatcatgtatttanagaggtcactaagccggccctcgacgggtccctgactcgcttctctcggctaccgaagttcgtaggacctaacgaccggtccctcccgtaggtacccgttctcgtcgggccttccgacgggtcgtaggaaggtagtcggacggtcttaggtaattttacgtacgttcggctacgtaccttgtaagtacggtaggggacgacgtacggaccgttaacgttaagttttcggggtacgttcgggacggggtaacggaaccgtaacggtcgttaaccgggaccggttacccgtaacggttccgaaccgggtacccgtacgggtcccgtacccggtacccccgttaccggg

SEQ ID NO: 174684 - DNA, 556 bp, Homo sapiens
  misc_feature: GYAE6OF02H4K6L.22.15.B04.1.454.CMB.1.raw
  modified_base (365)..(365): a, c, t, g, unknown or other
  misc_feature (365)..(365): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggacaaacgccccaaactcatgatttatgagtcactaagccggccctacgacggggtccctgactcgcttctctggctccaagtctgcaacncggcctccctgaccgtctcgtcgggctcccgaggccttggaggatggacggctggtatttaattacgtgacagtctacaattagtgggaagcagcgaattaagtttggtcggttcgggcgggaggaccgaaggcgtcggaccgtcgtaacggcacggacccgaggccctacggcccccttcggtcctaccg

SEQ ID NO: 174685 - DNA, 736 bp, Homo sapiens
  misc_feature: GYAE6OF02H0SGY.22.15.B04.1.454.CMB.1.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcacgtggaaccagcagtgaacgtttggtggttaataactnttgtcctcctggtaaccaacaacaccaggacaaacgcccccaaactcatgtatttangagtcactaagccgccctcgacgggtccctgactcgcttctcgtgcctacaagtctggacctaacgaccgtccctcccgtacgtacccgtctttaccgtcggggtacctacccgaacgggtcgttacgggaacgggtaatttacgggacgggttaccgtaagggtttaaacttttacgtttaaccttggtaccgtaacggtaccttacgaagtttaacggtgggtaaccggcgtaacggtaacggtaacgtttaaacggttttttgggtaccggtttacggggaacccgggggtaacgggtaacccgaaacggttcccgggtaacggtaccccggtttaccggttaaccgggttaaccgacccggtaacccgtaaccgggtacccgtaccccgggtaccccccgttaccggtacccttaccccgg

SEQ ID NO: 174686 - DNA, 638 bp, Homo sapiens
  misc_feature: GYAE6OF02IHPQ8.22.15.B04.1.454.CMB.1.raw
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
  modified_base (552)..(552): a, c, t, g, unknown or other
  misc_feature (552)..(552): n is a, c, g, or t
tcagacatacgcgtcacgaccggtgctcgatttagacagtatatatccgcggggggggtctcgaggaggcagcgctctcaggacgtcaccaccatggcctgggctctgctcctcctcagcctcctcactcgagggcacgagggtcctgggcccagtctgccctgactcagcctcccgtcgcgtccggtcnccgtggacngtcagtcaccntcncctgcacgtggaaacngcagtcgacgttggagttataactntgtctctgtacaacacaccagacaacgacccaacnctactagtattagtcgagtactacgaacgcggctacgaagggtcctagtacgtcgtacgttctcgtacggtcctaccgagtccgtcggtacaccgtaccggcccttaccctcgtacccggtctttacccgggcgggtccttacccggtaccgggacgttacgggaacggttgtacgggaacgggtcgtacggttatttaacgttccggtttagacgtacggtcctacgattaggtcgggatccgaggtcaagttcgttgggtntccgggtacggagacgagtcgaacggtaccgtccgtagggcccacggaccgtacggtccgtacccggtcccgtacgtccgtacccg

SEQ ID NO: 174687 - DNA, 614 bp, Homo sapiens
  misc_feature: GYAE6OF02IRNIC.22.15.B04.1.454.CMB.1.raw
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctcctgcactggaccagcagtgacgttggtgttatactntgtctctgtaccaacacaccagacaacgccccaatcatgtatttangaggtacactaagccgcctcgcgggtccctgactcgcttctcgtcgctccagttcnggacaacgccggccctcccgtcgaccgtcgttcgtcgggcctccgaggcgtaggacggacgtggacgtcgtagtatttacgttacgttcgacgtagtcttacgattacggtagggacgtacgacgggtactaacgtttaacgtttcgggttcggttcgggaacgggacgggtaccaaggtccgtaacgggtacccgttacgtaccggtaccgtaccggacccgtaacgggtcctccccgggttaccccgttccggtaccttcccgg

SEQ ID NO: 174688 - DNA, 517 bp, Homo sapiens
  misc_feature: GYAE6OF02GA39Y.22.15.B04.1.454.CMB.1.raw
  modified_base (305)..(305): a, c, t, g, unknown or other
  misc_feature (305)..(305): n is a, c, g, or t
  modified_base (461)..(461): a, c, t, g, unknown or other
  misc_feature (461)..(461): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacaccccaggcaaagcccccaaatcatgatttangaggtcactaagcggcctcagggtccctgatcgcttctctggcctccaaaggtctggcaaacacggccctccctgaccgtctcgtggctcgaggctgaggatgaggctaggtattattacgtgcagctacatatggaagcagcgaataagtttggngttcggcggaggacaagctagacccgtctaggtcacgccgaaggctccgcccgtcg

SEQ ID NO: 174689 - DNA, 626 bp, Homo sapiens
  misc_feature: GYAE6OF02HOHVC.22.15.B04.1.454.CMB.1.raw
  modified_base (308)..(308): a, c, t, g, unknown or other
  misc_feature (308)..(308): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaaccaacaacacccaggaccaaacgccccaaatcatgtatttangaggtcaacgtaacgccgccctcgacggggtccctggactcgtctttctcgtggcctccgtaagtcctaggaccaaccgtccggcccttccctacgtacccgttctccgtcgggcctccgaggcctggaggatggagtctagtaactttgttactgctagcttcaagttagtaggaggtcgacggtacgaacgttaaagtttcgggttacggttaccgggacgggtacgggtaaccgaacggtctacggtaacccggttaccggttaaggtaccgaaccggtacccgtaacgggcccttaccggtaccccccgttcgg

SEQ ID NO: 174690 - DNA, 723 bp, Homo sapiens
  misc_feature: GYAE6OF02FV7S7.22.15.B04.1.454.CMB.1.raw
  modified_base (303)..(303): a, c, t, g, unknown or other
  misc_feature (303)..(303): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttatactatgtctctgtaccaacaaccaccaggacaaacgacccccaaactcatgtatttangaggtcactacgccgccctacgacggggttccctaggtactccgtcttctcgtcggcctaccgtaagtcgtacggacctaaccgacccggtcccttccccgtacggtacccgttccgttacgtccgggtcctacccggaggtccgtagggacggtagtcgggacgtcgttagtaacttttacgttaacgtcgtactacgtcctacgtaagttacggtagggtacggaccgtaacgggtacgtaacgtttaacgggttttcggggttacggtttccgggggaacgggtaacgggaacccgtaaggtacccggttccggtaaccccgggttaccggttaacgggtaccctaacccgggtaaccccggtaacgggttccccgttaccgggtcccccccggtttacggtaccccgttaacccgg

SEQ ID NO: 174691 - DNA, 701 bp, Homo sapiens
  misc_feature: GYAE6OF02G7TJM.22.15.B04.1.454.CMB.1.raw
  modified_base (247)..(247): a, c, t, g, unknown or other
  misc_feature (247)..(247): n is a, c, g, or t
  modified_base (293)..(293): a, c, t, g, unknown or other
  misc_feature (293)..(293): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgtatactntgtctctgtaccaacaacaccagcaaacgccccaaatcatgattangacgtcactaagccgtccctgacgggtcctgatcgtcttctctgctctaagtctggacaacgaccgtccctcccgtgacccgttctcgtcgggcctaccgaggtccgtaggaacggtagtacgggacgggtcttacggttaacttttaacgtttaaccgtacggtaccgtaaggttacccttacgtaagttaaacgggttcgggaacggtaaccgtaacggtaaccgttaaccgtttaaaggtttttcggggttaccggttacccgggggacggggtaaccgggtaacccgtaagggtccgttaacccgggtacccggttaacccggttaagggttacccgaaccggtaccccggtaacggtccccggtaccccggttaccccccgttacgggttacccttaccccgg

SEQ ID NO: 174692 - DNA, 651 bp, Homo sapiens
  misc_feature: GYAE6OF02ICK6E.22.15.B04.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
tcagacatacgcgtcacgaccggtgctcgatttagacagtatatagtccgcgggggctggggtctcaggaggcagcgcgtctcaggacgtcaccaccatggcctagggctcgtgctcctcctcagcctcctcactcagggcacagggtcctgggcccagtctgccctgactcagcctcctcgcgtcggtctcctggacagtcagttcaccatctctgcactggaaccngcagtgacgttgngtaacagtatntctctgtaccaanaccacctaggcacacgacccaaactcatgtacttagngagtcacttaacgcggcctagacggggtccctgactcgcttctacgtggcctacgaagtcgtacggccgaacgaccggtccctcccgtcgtacccgttctcggtcgggcctacgaggtcctagggacggtatcggaacggtcttacggtaatttacgttaccgtacgtaccttaacttcgtaacttacgttcgacgtacggaccgtacgtaaccgttcggttcgggttacggttaccgggtacgggtaaccggtaccgtaacggtacccgttaccgggtaaccccgttaccgtacgggttaccaaccggtacccgaacgggtcccgtacccggtcccccgttaaccggg

SEQ ID NO: 174693 - DNA, 642 bp, Homo sapiens
  misc_feature: GYAE6OF02GJ3RF.22.15.B04.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (407)..(407): a, c, t, g, unknown or other
  misc_feature (407)..(407): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccngcagtgacgttggtggttaataactntgtctcctaggtaccaacaacaccaggcaaacgcccccaaatcatagtattatgacggtcactaagccgccctagacgggtccctgatcgtcttctcgtgccttcaacgtcgtagacaacgacgtccctccctgacccgtctcgtcgggcctaccgnggtctggacggtagtcgacgggtcttaggtaactttaattaccgtgtacctagccttagaacttacgagggacggcgaacggtacgtaattaaacggttttcgggtacggttaccggggtagggtaacggtaccgaacgttccgtaacgggtaccgttaccggttaccgggtaccaccgggtacccgtaaacggttcccgtacccgtacccccggtttggtaccccttaacccgg

SEQ ID NO: 174694 - DNA, 673 bp, Homo sapiens
  misc_feature: GYAE6OF02G8Y5O.22.15.B04.1.454.CMB.1.raw
  modified_base (227)..(227): a, c, t, g, unknown or other
  misc_feature (227)..(227): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactcggaaccngcagtgacgttggtaggttataactatgtctcctggtaccaacaaccaccgaggacaaacgacccccaaactcatgtatttatgacgtcaactaacggccggccctcgacggggtccctagactccgtcttcgtcgtcggcctacgtaagtcctacggactaaccgaccggcccttcccgtacgtacccgtctacgtcgggtcctccgacggtccgtaggtaggagtaggacgtcgtagttaatttacttacgtgtacacgtccttatagtagtagggacggtacgacgacgtaacgttaagtttggggtacggttaccggggaacggggtaacgggaccgtaacggtcccgtcgggtaaccccggttaccggtacgggtaccgaaccggacccggtaacgggtcccgttaccccgggtaccccccggttcggtacccttacccgg

SEQ ID NO: 174695 - DNA, 815 bp, Homo sapiens
  misc_feature: GYAE6OF02ISP2Z.22.15.B04.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (477)..(477): a, c, t, g, unknown or other
  misc_feature (477)..(477): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagcctcctcactcgagggcacagggtcctcgggcccagtcctgccctgactcacgccctcctccgccgtcgggtctccgtggacagtcagtccactactctcctgcacgtaggaaccngcagtgtacgttggtagttatactatgtctctcgtaacaacaacaccgagacaacgacccaactcatagtacttanggtacggtacaacgtaacgccggcccgtacgtacggggtccctagtacgtccgtcgtttctcgttcggccttaccgtaacgttcgtacggtaccaaccgaccggtaccctcccgttacggtacccgttcgtacgtcgggtcctccgaacggtcgtaggaagggngttacgggtacggtaccgttaggttaacttttaacggtttaaccgttcggtacctacggtaccttaacgtaacggtttaacggaacggggtaaccgggacgtaggtaacccgggttaaaacgtttacggggtttttaaccggggttacggggtttacccgggggtaccgggggtaaacggggtaaccccggtaaaccggggttacccggtttaaaccgggggtaaccccgggttttaaccccggttacgggggtttaacccggtaccggggttaaaaccccccggttacggggttacccccggtttaccccccggggtccccccggtttaaccccggg

SEQ ID NO: 174696 - DNA, 845 bp, Homo sapiens
  misc_feature: GYAE6OF02I3KN1.22.15.B04.1.454.CMB.1.raw
  modified_base (264)..(264): a, c, t, g, unknown or other
  misc_feature (264)..(264): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcaggcacgaggtcctgggcccagtctgccctagactcacgcctcccgtccgccggtcccggtcttccgtggacagtcacgtcaaccactctcctgacacgtacggaaccagcagtacggacgttcggtacgttaanaacgttgtcgttccttccgttacgggtaacccaaaccgtaacctaacccgacggtaaaccgaaaccggacccccccgtaaaaacttccctaaatacggtaactttttaacgagggtaccggttaaccttaacgaaccggtccggtaccctacggtaaccggggtcccctggtaacgtccgtaccgtttctaaccggtcggtccttaccgaacgtttcgacgaaccaccggtaccggtcccttacccgtaaccggtcccgttaccgttcggttacggcccgtccgaacgggttccggtagtaaccggtacgtcgggtaccgtacggttaacgtttaacgttaacctttcgggtaacccgtacgttacgaccgttacgtaacggttacggtacggtaaccgtaccgtacggtaaccgttaacggtttaccgggttttacgggtacggttaaccgggacgggttaaaccggtaccgtaacggtaccggtaaccggttaaccgttaacggtaaccggtaacccgacccggtaccggttaaccgttacccggttcccccgggaacccgtttaccggaccctaccgg

SEQ ID NO: 174697 - DNA, 737 bp, Homo sapiens
  misc_feature: GYAE6OF02IYKFQ.22.15.B04.1.454.CMB.1.raw
tcagacatacgcgtcacgaccggtgctcgatttagacagtatatatccgcggggggggtctcaggaggcagcgctctcaggacgtcaccaccatggcctgggctctgctcctcctcagcctcctcactcagggcacaggtcctgggcccagtctgccctgactcagcctccctccgcgtccggtctcctggacagtcagtcaccatctcctgcactcggaaccagcagtgacgtttggtaggttaataactatgtctccgttgtaaccaacaacaccagacaaacgcccccaaatcaactgaactttatgaaggtcactaagcggtacctcgtacgggtccctagactcgcttctcgtcggtctaccgtaacgttcgtaggccgactaccggcccttcccgcgtaccgtcttaccgtcgggacctccgtacggtccgttacggacggtagttaggacggtcgtacgtacgtttacttaaccgtagtaccgttaactacgtaacgtagttacgacggttaacgggccggtaacctaaccgtttacgggtttacggggtttcggttacggggtaaccggggtaaccggggtaacccgtaacgggtacccgtttaaccggggtaaccccgtttaaccggtaaccgggttacccggaacccgttaacccgggtaaaccggtaccccggttcccggtacccccccggtttaccgggttaccctaaccccggttttccccggg

SEQ ID NO: 174698 - DNA, 823 bp, Homo sapiens
  misc_feature: GYAE6OF02JTHFJ.22.15.B04.1.454.CMB.1.raw
  modified_base (228)..(228): a, c, t, g, unknown or other
  misc_feature (228)..(228): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcgagggcacagggtccctgggcccagtctcgccctgactcagccctccctcgcgtccgggtctcctggacagtcagtcaccatcctctgcactggaaccngcaggtcgtacggttgggtacggttaataacgttatcgtccttccgtacggtaaccaaaccaacctacccgacggtaccaaaaccgtaccccccaaatccatacgtaatttagtacgtaacggtacctaaccgtaaacggcccggtacccctacgggtaccggggttcccgttacggtaaccgttcccgtaccttttccgtaccgttaccggtacccgtaccgtaaacggttccggttacgggaacccgtaacccgtaacccggggtccccttacccccggttacggtaaccccgtttcccgtttccggtaccgggggtaccctacccgggaacggttccggtacggtaacgggtacttaggggtacggtccttaaggtaacttttaccgttacgtccgacggttaacgtcctaatacggttaacggtcgggtaacggtccgtaacgtaccggttaacttaacgggttttcgggacggttaaccggggtacgggaacgggtacccgtaggttccggaccggttaccgttcgtaacggtaccgacggtacccgtacggtacccgttccccggtaccccgttagtacccgttacccg

SEQ ID NO: 174699 - DNA, 644 bp, Homo sapiens
  misc_feature: GYAE6OF02JNUIZ.22.15.B04.1.454.CMB.1.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
  modified_base (404)..(404): a, c, t, g, unknown or other
  misc_feature (404)..(404): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgatggttggtagttataactatgtctcgtacggtaccaacagcacccaggacaaacgccccagactcatctagtttanacgtctacgtactaaagtaacggtccggccctacggtacgggtccctgtactcgtcctttctacgtcggactacgtaagtccgtagaccgtaaacnccggtcctccctacgacctactcctcgtacgggccttccgaggtctaggaacgtacgtaggacgtcgttaagttaacttacgttacctcggtcttcgccttacgtacgtttcggaccgtaccgggtcctaccgttaacgttacgggttcggtcgggttacggcgggtaacgggtacctaggtcccgtaacggtccgttaccggtacggtaccgaccgtaccggtacggttcccgtcccgg

SEQ ID NO: 174700 - DNA, 690 bp, Homo sapiens
  misc_feature: GYAE6OF02IA187.22.15.B04.1.454.CMB.1.raw
  modified_base (184)..(184): a, c, t, g, unknown or other
  misc_feature (184)..(184): n is a, c, g, or t
  modified_base (209)..(209): a, c, t, g, unknown or other
  misc_feature (209)..(209): n is a, c, g, or t
tcagacatacgcgtcacgaccggtgctcgatttagacagtatatatccgcgggggggggtctcaggaggcagcgctctcaggacgtcaccaccatggcctgggctctgctcctcctcacgcctcctcactcgagggcacgacgggtcctcgggccctagtctcgccctgactcacgtccctccnccgccggtccgggtctccgtggacncgtcacgtcaccatctcctgcacgtacggaacagctagtcgtacgttggtagttaactaacttgttcgtccttcgtacggtaaccaacgaaccaccgaacggaacaaaccgacccctaactcatacgtatttacgagtacgtacaacgtacggccgcctacggacggtcctacgacgttcctcttctacgtcgtctacgtagtcgacgacaccgcgtcctccgtcgtaccgtctcggtcggtacctcgacggtcgagacggtagttcgggacgtacgtagtaagtttactacgtagacgtacgtactacgaaggttaggtacgggtaacggtccaaagggttaccttaacggtttaacgggtttcggtcgggtacggggaacgggaacggtaccgtaaccggtcggtacccggtaccggtcggtaccggtaaccacggtaaccgccggtccgtaccccggttccgtacggtccctaaccgg

SEQ ID NO: 174701 - DNA, 831 bp, Homo sapiens
  misc_feature: GYAE6OF02JOWSC.22.15.B04.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
tcagacatacgcgtcacgaccggtgctcgatttagacagtatatatccggcgggggggggtctcaggaggcagcgctctcaggactcaccaccatggcctgggctctgctcctcctcacgcctcctacactcgagggaccacgacgggtccgtcgggcccngtcctcgacctgactcgcnccctccgtccggtcggtccggtctcgtacggactacgtacgacgtacctaaccgtacttcctcgtacgaaccgtacggtaaccggactacggtacgttaggttcggttaacggttagttaacgttaactacgttacgtcgttaacccgaacgaaccgaaaacccaccgaaccgaccgaaataccccctaaacctacttagtacgttagtttagacggaccggtaaccgaacgtacccggcggtacccgttacggaccgttgtacctaagtcttacgtccgcttacgcgtacaaccgttgacccggtataccgtccgactcgtccgcgttacggtcacggcgtacggagtacagggttacgacgtgtactacttacgtacgtactcggtactacggtacgtaacgaccgttaacgggttacacggggtttaagtaccggggtaggttacccgggttaaccgggtacgggtaacccggggttacctaaccggggtaacgttaaacccgggaccgggtttaccccgtcgggttaacccgggtaacccggtcccggtaccggttaccccggtaaccgttcccccggttaaccgggtttccctaacccggttcccgtttaaccccggtacccttaccgggtcccccgtttaacggg

SEQ ID NO: 174702 - DNA, 790 bp, Homo sapiens
  misc_feature: GYAE6OF02HVCHJ.22.15.B04.1.454.CMB.1.raw
  modified_base (117)..(117): a, c, t, g, unknown or other
  misc_feature (117)..(117): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagacatacgcgtcacgaccggtgctcgatttagacagtatatatccgcggggggggtctcaggaggcagcgctctcaggacgtcaccaccatggcctgggctctgctcctcctcngcctcctcactcagggcacagggtcctgggcccagtctcgccctgactcgagccctccctccgccgtccgggtcctccgtggacagtcagtcaccatctcctgacntacggacngcagtgtacgttggtgttaatactatgtcctcgtacgaacaacaaccaccagacaaccgaccccaaatcatntaattgagtacgtacactacgccggcctcggacggtcccngtactccggtccttctcgtcgtactaccgtagttcgtcggtacctaccgtacccgggtcccctcccgttacggtccccggttacttcccgggtacggtaccctacccggaggtccgttacgggacggtacgtacgggtacggtaccttaagggttacctttaacggtttacccgtaggttacccttaaccgttacgtacgtacgtaacgggaccggttacgggaacccgtaaccggtttaaccggtttccgggggtttacggttttccgggggttaacccggggtaccgggggttaaacgggaacccggtacgggttcccggttaacccgggtaaccccggttacggtaaccgggttaacccgaacccggttacccgggaacccggtttcccggtaacccccggtccccccgggtttacgggtaccccttaccggtttcccccccgg

SEQ ID NO: 174703 - DNA, 677 bp, Homo sapiens
  misc_feature: GYAE6OF02JQD4D.22.15.B04.1.454.CMB.1.raw
  modified_base (196)..(196): a, c, t, g, unknown or other
  misc_feature (196)..(196): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctcgcgtccgggtctccgtggacngtcagtcacatcctcctgcacgtaggaccagcagtgtacgttggtggttacaagtatcgtctcgtaggtaaccaactacccaccgaggaccacgaccgaccccaaactctacgtagtactttagtacggaaggtcctaacgtaaccggcccgtaccccgttaccggaccggggttcccttacggactccggttccttaccgtcgtacgccttaccgtaagtcgtacggacaaccgtccgtaccctccgtacggtaccgtcttccggtcggccttaccggagtcgtaggtaggacgtacggtacgtagttacgtaagtttaccgttgacgtaccagtctacgtagtacggtggacgtaccggtagtaacgttacgttagggtttacggtcgggttacgaccggggacgttacgaacgttcggacgtaaccggttcgaacgtccgaacgtaccgaggtcctaccccgtaccggtccttaaccg

SEQ ID NO: 174704 - DNA, 727 bp, Homo sapiens
  misc_feature: GYAE6OF02JN7LM.22.15.B04.1.454.CMB.1.raw
  modified_base (173)..(173): a, c, t, g, unknown or other
  misc_feature (173)..(173): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (344)..(344): a, c, t, g, unknown or other
  misc_feature (344)..(344): n is a, c, g, or t
tcagacatacgcgtcacgaccggtgctcgatttagacagtatatatccgcggggggggtctcaggaggcagtgctctcaggacgtcaccaccatggcctgggctctgctcctcctcagcctcctcactcagggcacagggtcctgggcccagtctgccctgactcagcctccnccgcgtccggtctcctggacagtcagtcaaccntctctgcactggaccngcagtgacgttggtagttataactntgtctctggtacaacgacaccaggcaacgccccaaancatnactttancgacggtcaactacgccggtcctcggacgggtcctgactacgtccttcncgtcggtcctacctaaggttccgtcggtacaccgtacggcccttacctcgaccgttcgtcgtcggtcctaccgtcggtcgacggaggtacgttcggacggtcgttacggtaactttacggttaacttcgtacggtaacctcgttaccgtaacgttaacggttacggggaacgttaccggaaacggtaccgtaaaccggtttttaaggttaaccggtttcggggttacgggaacccggggttaacgggacccgggtaacgttacccgggtaaaccgggtttacccggtccgggttaaacccggttacccggaacgttacccccgggaaacggttccccgtaacccgggttaacccccggtttacccggacccgtttaaccccgg

SEQ ID NO: 174705 - DNA, 723 bp, Homo sapiens
  misc_feature: GYAE6OF02GGW3N.22.15.B04.1.454.CMB.1.raw
  modified_base (232)..(232): a, c, t, g, unknown or other
  misc_feature (232)..(232): n is a, c, g, or t
  modified_base (520)..(520): a, c, t, g, unknown or other
  misc_feature (520)..(520): n is a, c, g, or t
  modified_base (559)..(559): a, c, t, g, unknown or other
  misc_feature (559)..(559): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctgccctgactcagcctccctccgcgtccgggtctcctggacagtcagtcaccatctcctgcactggaaccagcagtnacgttggtaggttatactatcgtctaccgtacggtaaccaacgtaaaccacccagggaccaaaacgacccccccaaactcaacgttgtaattttacgaggacggtacctaacgtaacggcccgtaccctcggtacggggttaccctagtacgtccgtctttaccgtcgttacgggaccttaccgaaggttccgtacggaccctaaaccgcccggtaccccttccccgtcggtaacccgttcgtaccggtttcggggcccttaccggaagggtcgtaacgggtaagggngttacgggagggtccttaagttagtttaactttaccggngtacagtacctagtagttcgtacggacgacgtaacgtacgttaagttaggtttcgggtcggtaccgggacgggaacggtacgaaccggtccggtacccgtaacggtaccgtaggtaccgaccggacccgtacgtcccgtcccggtaccccgtttcgaccctccg

SEQ ID NO: 174706 - DNA, 658 bp, Homo sapiens
  misc_feature: GYAE6OF02JR75F.22.15.B04.1.454.CMB.1.raw
  modified_base (174)..(174): a, c, t, g, unknown or other
  misc_feature (174)..(174): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagacatacgcgtcacgaccggtgctcgatttagacagtatatatccgcggggggggtcgtcaggaggcagcgctctcaggacgtcaccaccatggccgtgggctctgctcctcctcagcctcctcactcgagggcacgagggtccgtcgggcccagtctcgccctcgactcncgtccctccctcccggtccggtccgggtcctccgacgacgtcgtactacgtccaactctcctccgtcttacctgggaaaccccaggccaaggtcgaacgtttgggtgggttataacgtaattgtctcctgggtaccaacaccacccaggccacagcccccaaatccaatgattatgaggtcnactagcggcncgacggtccgtgactcgtcttctctcgtctcacgtctcggcgacgccgtccgtcccgtcgtaccgtcgtcgtcggtcgtccgacggtcgtacggacggagtacggtacggtcgtagtacttagtttacgttcgtacttactactactttacgtcgtacggccgtccgtacgtacgtttcgggttcgggtcgggtacgggtacgggacggacgtaccgtacggtaccgttaccgtacggtaccgtaccgtaccggacggtccggtcccggtcccggtccgtaccgtccgtccg

SEQ ID NO: 174707 - DNA, 736 bp, Homo sapiens
  misc_feature: GYAE6OF02G9WHI.22.15.B04.1.454.CMB.1.raw
  modified_base (243)..(243): a, c, t, g, unknown or other
  misc_feature (243)..(243): n is a, c, g, or t
  modified_base (464)..(464): a, c, t, g, unknown or other
  misc_feature (464)..(464): n is a, c, g, or t
tcagacatacgcgtcacgaccggtgctcgatttagacagtatatatccgcgggggctggggtctcaggaggcagcgctctcaggacgtcaccaccatggcctgggctctgctcctcctcagccctcctcactcgagggcacgagggtcctcgggcccagtcctgccctgacctcacgcccttcccgtccgcgtcccgggtctccgtggacacgtcagtccaccatctctcgcactaggaaccngcagtcgacggttggtagttactaactatcgtcttccgtacggtaccaaccaaccaccgacggaccaaaccgaccccctaaaactccaatagtaacttttagacggtagtacaacgtaacggccggtacccgtacggacggggttccctaggtactccggtctttctcgtacggtcctacgtaacgttccgtcggacaaccgtacccggtcccgtacccgngtacccgtcgtcgtccggtcttacccggaggtcgtagacgggtacgttacggacgtcgttagttaactttacgttacgtcgtcgttgtaccttcgttatttccggacgtaccgggcctaccggttaacgttcggtttacgggttcggtacggggtaccgggtaacgggaccgtaccggtccgggttaccggtaccggttaccggttacggttaaccggccggtaacccggtaccgggttacccgtccccggttaccccggttccgttacccg

SEQ ID NO: 174708 - DNA, 661 bp, Homo sapiens
  misc_feature: GYAE6OF02H87NM.22.15.B04.1.454.CMB.1.raw
  modified_base (227)..(227): a, c, t, g, unknown or other
  misc_feature (227)..(227): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtagttataactatgtctctgtaccaacacaccaggacaaacgcccccaaatcatgtattatgacgtcaacgtaacgccggccctcggacgggtccctagactcgtacttctcgtcgtcctccgtaagtcgtacggaccaacggtccgtcccttacccgtcgtacccgtcttaccgtcggggacctccgacggtcgttcggaaggtagtcggacggtcgtagtaagtttacgttaacgttgacgtacgtcctacgtactatacggacggtacgccgggactaacggtttcggttcgggttcggtaccggggtcgggtaacgggaccgaaacggtccgtacgggttacccgtacggtaccggttaccgaccggacccgtaacgggtccctacccggtcccccggttaccggtcccgtaacccg

SEQ ID NO: 174709 - DNA, 599 bp, Homo sapiens
  misc_feature: GYAE6OF02IB6JC.22.15.B04.1.454.CMB.1.raw
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtagttataactntgtctctgtacaacaacaccagacaaacgccccaaatcaatgtatttangagtacacgtacgcgacctgacgggtcctagactcgcttcncgtcggtctacgtagtcgtcggacaaacgtccgtcccttccgtacggacccgtntccgtcggacctccgtaggtcctagaggtctaggacgtctagtaattaacttacgtcgactacgtctacagtagtggacgtacgacgtacgtaacttaagttcggtacggttcgggacggtacggaccgtaggtcgtaacgtaccgttacgtacggttacacggtccgtaacggccgtacccggtcccgttcggtactaacccgg

SEQ ID NO: 174710 - DNA, 658 bp, Homo sapiens
  misc_feature: GYAE6OF02GUZM5.22.15.B04.1.454.CMB.1.raw
  modified_base (265)..(265): a, c, t, g, unknown or other
  misc_feature (265)..(265): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcagggcacagggtcctgggccagtctcgccctgactcacgccctccctccgccgtccgggtctccgtggacagtcagtccaccatcctctcgctacgtcggaaccagcagtggtacgttggtagttaatattactnttacctccgtggtaaccaacacgccaaccgacgacaaaccgcccccagactcactctattgtggtctcaccgtcggtccgccctgtaggtacgttcctctacctagtccgttccttcgtacgacgtcctacgtacgtcgaccgactaaccggacccgtacccttaacctaacctaccgtcgtccggtaccggtccttccggttacgtttacgggacgtacgtaacgttacctttaacgttaactttctcgttaccttacgtttacctttaacgtcgtcctaccttcgtcgttcggtttcggttcgcggtacgaccgtacgacgtacgtccgtccgtacggcaccgtcgtacgtccgtcccgtacccgtcgtcctacgttccgtacctaccccg

SEQ ID NO: 174711 - DNA, 720 bp, Homo sapiens
  misc_feature: GYAE6OF02IEXED.22.15.B04.1.454.CMB.1.raw
  modified_base (256)..(256): a, c, t, g, unknown or other
  misc_feature (256)..(256): n is a, c, g, or t
  modified_base (302)..(302): a, c, t, g, unknown or other
  misc_feature (302)..(302): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcgagggcacagggtcctgggcccagtctgccctgactcagccctccctccgcggtccggtctcctggacagtcagtccaccatcctcctgcactacggaaccagcagtgacgttggtagttactaatntgtctcgtaggtaccaacaacaccacgacaaacgccccaactcatntacttatcgagcactagcggcctcgacgggtccctgactcgtcttacgtcgtcggtcctaccgtaacgtcgtacggaccgaaccgtacccggaccccttcccgtaccggtacccgttcgtccggtcgggtaccctccggtaaccggtcgtacgggaaggtacgtacgggtacggtaccgttaagttacgtttaacgtttaccgtacgtaccgtacgtacctacgtaagttacggttacggggacggtaccgacggtaaccgttaacgttaacggtttcgggttacggtccggggtaacgggtaccgggaccgttaccggtaccgttaccggtaaccccggttacgggtaccgttacccgaccggaacccggtacggtacccgtccccgggtaccccgttaccggtacccttaccccgg

SEQ ID NO: 174712 - DNA, 801 bp, Homo sapiens
  misc_feature: GYAE6OF02I1D26.22.15.B04.1.454.CMB.1.raw
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagccctccctccggcgtccgggtctccgtggacagtcacgtcaccattcctccgtgcacgtggaaccngcagtgacgttggtagttatactntgtctcctggtaccaactaaccaccaggacaaacgccccaaactcatgaatttagtgaggtcaacgtaagccggtccctcggaacggggttcccctagtacgtaccggtctttccacgttcgggaccttacccctaaaggttccctaggaccctaaaccgacccgggtaccccttaccccgtccggtaacccgttccgtcgttcggggtaccttacccggaacggtcgtacggtaacggagttcgggaacgggtccttaggtaacctttaacgttccgtacggaccgtacgtacccgttccgtaagttaacggtacggggacggtaccggaccggttaaccggtaacgttttaaacggttttcggggttaccgggtttacggggaacccgggggttaacggggtaaccctacggggtaccgttaccccggggttacccggttaccggtttacccgggaaccggtaaccccgggtacccggtaaccgggtttccccggtaccccgggtaccccccgtttaccggggtcccgttttaacccccggg

SEQ ID NO: 174713 - DNA, 721 bp, Homo sapiens
  misc_feature: GYAE6OF02GX6T6.22.15.B04.1.454.CMB.1.raw
  modified_base (268)..(268): a, c, t, g, unknown or other
  misc_feature (268)..(268): n is a, c, g, or t
  modified_base (336)..(336): a, c, t, g, unknown or other
  misc_feature (336)..(336): n is a, c, g, or t
tcagacatacgcgtcacgaccggtgctcgatttagacagtatatatccgcggggggggtctcaggaggcagcgctctcaggacgtcaccaccatggcctgggctctgcctcctcctcagcctcctcactcgagggcacgagggtcctgggcccagtctcgccctgactcacgcctccctccgcgtccgggtctcctggacagtcagtccacatcctcctgacctacgtcggaaccagctagtcgtacggttggtagttaactaacttntcgtcctccgtacgtaaccaacaaccaccgacgaccaaaccgaccccaaactcactagtaatttacgngtacgtacgaaccgtacggcccggacccgtacggtaccggggttcctacggtacgtccgttccttacctcggttcggtaccgtaaccgtaacggttccgtacggaccaaaccggtacccgtccccgttaccccgtacggtacccgtccgtaccggtcggtaccctccggacggtccgtagggtacggtacgtaggacggtacgttagttaactttacgttccgacgtacaccgttctacgtagttacgagggaccgtcgacgtacgtacgttaggttcggtacggttccggacgaccggtacgacggtcgttaccggtaccgttaccggtcgtaccgacgggtacccgacgggtccctccccggaccgttccggtacctacccgg

SEQ ID NO: 174714 - DNA, 713 bp, Homo sapiens
  misc_feature: GYAE6OF02H3R18.22.15.B04.1.454.CMB.1.raw
  modified_base (419)..(419): a, c, t, g, unknown or other
  misc_feature (419)..(419): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacgagggtcctgggcccagtctgaccctgactcagccctccctccgcggtccggtctccgtggacagtcagtcaccatcctcctgcacgtacggaaccaggcaggtgtacggtttgggtgttaataacgtattcgtcctcgttacggaaccaacaaccaccgaggaactaaacccggaccccctaaagtcagtagtattatcggagtaccaagtaacgccggtaccctggtaaccggggtcctaggactccggtcttaccgtcgttcgccttaccgagttccgnggaacaaaccgccgtccctcgacgtacctcgtacgtcggccttaccgaggtcgttaggacggtaagtggacgggttactaggttaaactttagtacgtccgtagaacgttctagtaacgtagggtaagggacgtaacgacggtaacgtaaccgttttaggtttcggggtaggttaaccgggggagtaaaccgggacccgttaagcgttaacccgggaacccttgggttaacgaacccgtcggaacccggtacggaccccgttcccggtaccccggttaccggtcccttaacccg

SEQ ID NO: 174715 - DNA, 662 bp, Homo sapiens
  misc_feature: GYAE6OF02H0ZF8.22.15.B04.1.454.CMB.1.raw
  modified_base (309)..(309): a, c, t, g, unknown or other
  misc_feature (309)..(309): n is a, c, g, or t
  modified_base (439)..(439): a, c, t, g, unknown or other
  misc_feature (439)..(439): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctcgcgtccggtctctggacagtcagtcaccatctcctgcacgtcgaaccagcagtgacgttggtggttaataactatgtctcgtagtaacaaacaacaccgaggaccaaaccgccccaaactcatcgtatttagngagtcacgtaacgccgccctgacgggtcctgactcgtcttctcgtcggccttacagttcgtacggaccgaaccgacccgggtcccttaccccgtaggtaccccgtcgttccggtccggggccttaccggnggtccgtaggaaggtacgtggacgggcttaggtaactttacgttaacgtgtaccctaactcgtatcgtacggcgaccgggtacgaccttaacggttgggttcggggttccggtaccggggacggtaaccgggtactacggtcgtaccggtaccgttacgtacggtcgacccggaccgtacggtcccgtcccggtaccccggttacgtaccgtaccgttcccgg

SEQ ID NO: 174716 - DNA, 658 bp, Homo sapiens
  misc_feature: GYAE6OF02GLNQ1.22.15.B04.1.454.CMB.1.raw
  modified_base (212)..(212): a, c, t, g, unknown or other
  misc_feature (212)..(212): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (425)..(425): a, c, t, g, unknown or other
  misc_feature (425)..(425): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctccngcactggaaccagcagtgacgttggtgtataactatgtctctggtaccaacaacaccagacaacncccccaactcatgtatttangtaggtccaactaacggtccggaccctcgacggggtcctgactcgcttctacgtcggctcctaagtctacggactaaccgaccggtccctacccgtacggtaccgttctcggtcggggtcctacccgnggtcgtacggagggtcgtacgggagtaccgttggtaactttaagttacgtgacctacgtactaccaggttagacgggacggtaccaggtacgtaacttaccggtttggtacgggttcgggacgggtaacgggaacctacgggtcgttccggtaacccgtaccgggttaaacggttcccgaccgtaacgggtcccgttaaccggccccccgttacggttaccaccgtttcccgg

SEQ ID NO: 174717 - DNA, 735 bp, Homo sapiens
  misc_feature: GYAE6OF02IN7UC.22.15.B04.1.454.CMB.1.raw
  modified_base (230)..(230): a, c, t, g, unknown or other
  misc_feature (230)..(230): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctcgccctgactcagccctcccgtccgcgtccgggtctccgtggacagtcagtcaccatctcctgcactcggaaccngcagtcgtacggttggtagttacttaactatcgtctcgtacggtaaccaacgaaccaccgaggacaaaaccgcccccaaatcaatgtaactttacgtagtacggtcaacgtacggccggtacccgtacgaacgggggttcccctagacgtccgtcctttcgtccgtggtccctaccgtaacggttccgtacggacctaaaccggtccgggtacccttaccccggtacgtacccgttccttccgggtccgggtaccctacggaacggtcgttaggaaacggtcgtagggtacggtctaggttaactttacgttaacgtcgacgtacgtcttactaacgttagtacgggacgacgtacgacgtaacgttagtttcgggttcgggtacgggtaccgggaaggtacctaggtccgtaacggaacccggtttcggtaacggacccgtaaccggtacccggtaagggttccccgttcccgggtacccccgttacgggtaccctttaacccg

SEQ ID NO: 174718 - DNA, 613 bp, Homo sapiens
  misc_feature: GYAE6OF02G5R1C.22.15.B04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
  modified_base (261)..(261): a, c, t, g, unknown or other
  misc_feature (261)..(261): n is a, c, g, or t
  modified_base (549)..(549): a, c, t, g, unknown or other
  misc_feature (549)..(549): n is a, c, g, or t
  modified_base (610)..(610): a, c, t, g, unknown or other
  misc_feature (610)..(610): n is a, c, g, or t
tcagacatacgcgtcacgaccggtgctcgatttagacagtatatatccgcggggggggtctcaggaggcagcgctctcaggacgtcaccacatggcctgggctctgctcctcctcagcctcctcactcgagggcacgagggtccgtgggcccagtctcgacccttgacctcgagtccctccctcggcgtccggtcnccgtagacngtcagtcacagtctcngcacgtggaccagtcagtcgtagttggtacgtataacgtntcgtctctacggtacaaacgaccaccgacgaacccctaaacccccgatacctacttacgttaacgttttacgcggttactacctacgtccggtcccgacctagcggtactactcgactctcgtacttcgtcaacggtctacgagttcgagaccacggacccgtcctaaccgtactacgtcgtcgtcgggaccctttcgtaggttcgaacgtacgtacgtcttaacttaagtcacgttactttacgtttaaacttagtcgacctcgtacttcggttacgtacgtccggngtacgctaacgagtcgacctgtcgatccgaactcgctccgcctgactcgctccgtcacctnacg

SEQ ID NO: 174719 - DNA, 733 bp, Homo sapiens
  misc_feature: GYAE6OF02GCXLR.22.15.B04.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcagggcacagggtcctgggcccagtctgccctgactcagcctccctcgcgtccgggtctccgtggacagtcagtcaccatcctcctgcactggaaccngcagtgacgttggtgttataactntgtctctgtaccaanaacaccaggacaaaccgccccaactcatgtactttangaggtacacgtaagccgccctcgacgggtcccagtactcgtacttcgcgttcggactaccgtacgtcgtacggacctaaacgaccgtcccgttaccccgcgtcccgttccttaccggtcgggtaccctcccggtaagggccgtttagggaacgggtaactacggggtacggggtcttacgggtaacccttttaagttaccgttacggcgtaaacgggtcttacctaagttaaggttccggggaaggttccgaacggggtacttaaccggtttaaaggtttttgggttaccgggttacggggaaccgggggtaacggggtaaccctaacgggtccggttaaccggtcccggttaaccggtacggttacccgacgggtacccggttaacggcccgttacccccggcccccgttttacgggtcccttaacccg

SEQ ID NO: 174720 - DNA, 619 bp, Homo sapiens
  misc_feature: GYAE6OF02HBMQ7.22.15.B04.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (391)..(391): a, c, t, g, unknown or other
  misc_feature (391)..(391): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtcccggtctcctggacagtcagtccacatctcctgcactggaaccngcagtgacgttggngttanactatgtctcgtagtaccaacaaccacccagaccaaacgcccccaaactcatcgtaattatgaggtacacgtaaggccgtccctcgacgggttccctagactcgtccttcgtctggctccgaagtcgtggacgacacgccctcccgngaccgttctccgtggcctccgtaggcgtgaggtagtcgggtagctaggttattacgttacgtcgtactacgtctatacgtgacgtacggcgacgttaacgttcggttgggttcggtacgggacggaccggtaacgacgttcgaccggttaccgtaccggttacgtaccgacggtaacccggacgtcccggtaccccgtccccggtaccggttccaccgtttaccccgg

SEQ ID NO: 174721 - DNA, 698 bp, Homo sapiens
  misc_feature: GYAE6OF02ILTZF.22.15.B04.1.454.CMB.1.raw
  modified_base (154)..(154): a, c, t, g, unknown or other
  misc_feature (154)..(154): n is a, c, g, or t
  modified_base (462)..(462): a, c, t, g, unknown or other
  misc_feature (462)..(462): n is a, c, g, or t
  modified_base (514)..(514): a, c, t, g, unknown or other
  misc_feature (514)..(514): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcgagggcacgagggtcctgggaaccngtctcgccctgactcacgccctcccgtccggccggtcccgggtcctccgtggacctaggtcacgtcaacctctcctcctgacctacgacggaccagcgagtcgtacggttggtagttaactaactagttctccgtaccgtacggtaaacctaacgaaccgaaccgacggaaccaaaccgaccccccaaaacttcaactgtaatttaggtgacgtacacgtaacgccgtaccgtcggacgggtcctagtctcgtcttcgacgcgtcctaactagtcgtacgacaaccgtcggcctccgacgtccgtcgnggtccgctacgcggcgtggacgttggagtacgtactaggttacttattcgtntacggactacgtactaagtggtacgacggtacgaacgtctaaagtttagggttccgggttagggtccgggaacggggtaaccgacgtacggttacccgtacgggttaccggtaccggtaacggttaccgacccgacggttaccggtcccgtaccccggtacccttaccggggtaccttcccggg

SEQ ID NO: 174722 - DNA, 604 bp, Homo sapiens
  misc_feature: GYAE6OF02G5DG9.22.15.B04.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctctgcactggaaccngcagtgacgttggtgttataactntgtctctggtaccaacaaccaccaggacaaacgcccccaaactcatgattatgagtcactaacgcgcctcgacgggtcctgatcgtcttctctcggtctcaacgtctacggacaacgacggtccctccgtcgaccgttcgtcgtcgggcctcccggaggtcgtacggacgtagtggaacgggtctagtagtttaacttacgtagctacgtctacgtaagttagtcgggagtcgagacgtaacgttaagtttgggtacggttcgggacggtacggaccgtagtcggtacggacccgttcgtaacggtaccgacgacccggtaacggtcccgtacccggtaccccgtcggtacctacccg

SEQ ID NO: 174723 - DNA, 673 bp, Homo sapiens
  misc_feature: GYAE6OF02HYYHD.22.15.B04.1.454.CMB.1.raw
  modified_base (125)..(125): a, c, t, g, unknown or other
  misc_feature (125)..(125): n is a, c, g, or t
  modified_base (198)..(198): a, c, t, g, unknown or other
  misc_feature (198)..(198): n is a, c, g, or t
tcagacatacgcgtcacgaccggtgctcgatttagacagtatatatccgcggggtgggtctcaggaggcagcgctctcaggacgtcaccaccatggcctgggctctgctcctcctcagcctcctnactcgagggcacgagggtcctgggcccagtctcgccctgactcagccctcctccgcgtccggtctcgtggacngtcagtcaccatctcctgccactcggaaccagcagtggtacgttggtagttaatactattgtctctgtaccaacaacaccagacaacgaccccaaactcatagtatttagtaggagtcgtacgtaacggtaccggccctacggtacgggttccctcggtacgtcgttcttacttcgtcgtcctacgtaagtctacgaccgacaccggtccctacccgtcggacccgttcttaccggtcggtcccgtcgtccggcgtagacgggtagtcggacgtcgttaagtaactttacgtttacgtgtactacgcgtactagtagtacgggcgtaccgacgtaacgacgtttaaggtttggtccggttcggggacggtaacgggtacgtacggcggttaacccgggtcccgttaaccggtacgggtaccgaccggtaacccggtacggtaccccgtcccggttacccccgtacggttaccccg

SEQ ID NO: 174724 - DNA, 671 bp, Homo sapiens
  misc_feature: GYAE6OF02F1U6U.22.15.B04.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (400)..(400): a, c, t, g, unknown or other
  misc_feature (400)..(400): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacgagggtcctgggcccagtctcgccctgactcagccctcccgtccgcgtccgggtctccgtggacngtcagtccaccatctctgcactacggaaccagcagtcgtacgttggtaggttactaacgtnttgtctaccgtaggtaaccaaacaaccacccgaggaccaaaccgacccccaaactcatacgtatttagngacggtcaacaacggtccgtacctacggacgggtcctgactcgtcttccgtctggcctacgtagtcgngacaacgtaccggtcctacccgtcgtaccgtctcggtcggtacctccggagtccgagggtacgaggtacggtacggtcttaagtaagtttaaccgttcgtacggtaccaggttacctaacgtagttacgggttcgggaacgtacgggaacttaaccgtaacgtttagtttcggggacggttacgggacgggtaacgtacgacgtaccggtacgtaccgtacgtaccgacgaccgtaccgacggtccctacccggtcccgtcgtcctacccg

SEQ ID NO: 174725 - DNA, 745 bp, Homo sapiens
  misc_feature: GYAE6OF02IPBOZ.22.15.B04.1.454.CMB.1.raw
  modified_base (117)..(118): a, c, t, g, unknown or other
  misc_feature (117)..(118): n is a, c, g, or t
  modified_base (192)..(192): a, c, t, g, unknown or other
  misc_feature (192)..(192): n is a, c, g, or t
  modified_base (208)..(208): a, c, t, g, unknown or other
  misc_feature (208)..(208): n is a, c, g, or t
  modified_base (657)..(657): a, c, t, g, unknown or other
  misc_feature (657)..(657): n is a, c, g, or t
tcagacatacgcgtcacgaccggtgctcgatttagacagtatatatccgcggggggggtctcaggaggcagcgctctcaggacgtcaccaccatggcctgggctctgctcctcctcnncctcctcactcagggcacgaggtcctggccagtctgccctgactcagcctccctcgcgtccggtctccgtgacngtcagtccacacttcnccgtgcctactcggaacctgcgagtcgtacggttgtaggttactaactgttgtccttacgtcgtaaccaaactaccgaccgacgacaaaccgaccccaactctactagtacttagaggtacgtactaacgtaacggtcccggtaccgttcggacccgggttccgtagtacgttccggtacgttccgttccgtagtaccttaccgtaacggtttacctccgggtaacctaaccggtccgtacccgttccccgtacggttaccccgttccgttccggtacgggtacccgtcccggtaccgggtaaccggtcgggtaaggtaccggttaggtacgggttcttacggtttaaacgtttcgtttaaccggtgtacgtcgttactacgttagtaacgttcgggacgtacgtaacgacggtacgttaggttttcggtaccggttcgaccggggtanaccggacgtaccggtcggttaccgtacggtacggtacccgacggtacccgtcggtaccccgttccccggtacctccggtaccttcccg

SEQ ID NO: 174726 - DNA, 717 bp, Homo sapiens
  misc_feature: GYAE6OF02JEXGB.22.15.B04.1.454.CMB.1.raw
  modified_base (227)..(227): a, c, t, g, unknown or other
  misc_feature (227)..(227): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactggaaccnggcagtgtacgttgggtgttaataactatgtctcctcgtaccaaccaccaccgacgcaccacgaccccaacgtcatacgtatttatagacggtcaacgtacggccggaccgtcgacggggtcctgatcgtcttctcgtcggacctacctaacggttcgcgggtaccaccgtaccggtcccttacccgtaccgtacccgttcgtccggtacgggtcccgtaccgacgggtcgttaggacggtagtgggaacgggtcttaggtaatttaccgttacgttaccggtaccttacgtaccttcggtttaccgtcgtaccgggtcccgtacccgttacggtaccgggttttgggttccgggttaccgggaacggggtaccggaccgtacggttcgtacccgggtaaccgttaccggttacggaacccgtaacccgacccggtaacggtccccgtaccggttaccccccggttacgtcccgtacccgtttaccccgg

SEQ ID NO: 174727 - DNA, 741 bp, Homo sapiens
  misc_feature: GYAE6OF02HBMW8.22.15.B04.1.454.CMB.1.raw
  modified_base (199)..(199): a, c, t, g, unknown or other
  misc_feature (199)..(199): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctccgcggtccgggtctccgtggacngtcagtccaccatctcctgccacgtggaaccagcagtgacgttggtacggttacaagttatcgtcctccgtacggtaaccaaccacccgacccaggaccaaccgaccgaccccccaaaactcaagttacgtaatttagaggtacggttaccaacggtaacggccggggtacctcgggtaccgggtcctagtacgtccgtctttcgtcgtacggtacctaccgaacgttcgtcggaccgaccgtacccggtcccttcccgtacggtaccgttcgttccggtcggtcctcccggaggtccgtagggtacggacgtcgggacggttctaggttactttacgttaccttcgtaccttacgtactacgttagtccggacggacggtacggtaccgttacggtttccgggttggggtttacggtacggggaccgggaaccgggtacgtaccggtaccggtccggtacccggttacggtaccggttaccgacccggtacccggtaaggtcccccgtacccggttcccccggttaggtacccttacccgg

SEQ ID NO: 174728 - DNA, 601 bp, Homo sapiens
  misc_feature: GYAE6OF02IW3EL.22.15.B04.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
tcagacatacgcgtcacgaccggtgctcgatttagacagtatatatccggcgggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggcagtcagtcaccatctcctgcactggaaccngcagtgacgttggagttanactntgtctctgtaccaacaccaccaggcaaacgccccaatcatgtattngagtcaactagccgtcctcgacgggtcctgcgtcgcttctctcgctaccgagtctcgacaacnccggcctcccgtacgcctctcgtacgggcctcgacggctaggacggtatggacgtacgtaattacgtacgtcgtcagtacctcgtagtacgtaggtaccgtacgacgacgtaacgttaggtttcgggttaggttccggacggggtaacggaccgtaggccttacggtacccggttacgtacgggtaccacccggtaccgtacggtccgtacccgtaccccgtcggtaccctaccgttacccg

SEQ ID NO: 174729 - DNA, 700 bp, Homo sapiens
  misc_feature: GYAE6OF02JHZHH.22.15.B04.1.454.CMB.1.raw
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (447)..(447): a, c, t, g, unknown or other
  misc_feature (447)..(447): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcagggcacgagggtcctgggcccagtctgccctgactcagcctccctcgcgtccggtctccgtgacagtcagtcactatctctgccactcggaaccngacagtcgaacggttgggtaggttacaagtntcgtactccgtacggtaaccaaccacctaaccgaggacaacgaccgaccccctaaactcattacggtatttacgagacggtactaacgtacggccgtcccgtacggtacgggtccttagactcgtacttcgtacgtcgactacgatcgttacggaccaaccgtacggtccctaccgtacggtacccgtttntaccggtacgggtaccctacggtacggtacgtagggtaacggtgtaccgggtacgtacggttacggtaacttttacttacggtacggtactacgtcctacgttaagtacggtaggaccggtacgacgtacgtaagttacggtttcggacgggtttcgggaacggtacggtacgtaccggtacgtaccgtacccggtaccgtgggtaccctacggacccgaacggttccgtacccgtacccggttacgtacccg

SEQ ID NO: 174730 - DNA, 753 bp, Homo sapiens
  misc_feature: GYAE6OF02HNZI3.22.15.B04.1.454.CMB.1.raw
tcagacatacgcgtcacgaccggtgctcgatttagacagtatatatccgcgggggctggggtctcaggaggcagcgctctcaggacgtcaccaccatggcctgggctcgtgcctcctcctcagccctcctcactcgaggcacgagggtcctgggcccagtctgccctgactcagccctccctccggccggtccgggtctccgtggactaggtcaggtccacctagttcctccgtgccacgtcggaaccagcagtggtacgttggtagttataactgtcgtctccgtacggtaaccaaccaaccacccgaggaccaaaccgacccctaactacatagtattacgaggtacgtacgtactaacggtccggcccgtaggtacgggtccctgactccgtacttccgtacgtcggtacctccgtaagtcgtacggaccaaccggtacccgtcccttacccgtaccgtacccgttccgtcggttacccgggtaccgttaccgggtacggtccgtacggggtaaccggacgttacgggaaccggttacgttaggttaacgttttaaccgttaccgtagcgtaacggttcccgtacgttacgtaggtcgggaacgtcgtacgtacgttaagttacggttacggtcgggttacgggccgggttacggaaccggtcggtaccggtaccgtacccggtaccggttaaccggtcccgtaaccgggtacccgtaaccgggtcccttacccggtccccggttaaccg

SEQ ID NO: 174731 - DNA, 892 bp, Homo sapiens
  misc_feature: GYAE6OF02HBH3G.22.15.B04.1.454.CMB.1.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
tcagacatacgcgtcacgaccggtgctcgatttagacagtatatatccggcggggggggtctcaggaggcagcgctctcaggacgtcaccaccatggcctggctctgctcctcctcagcctcctcactcgagggcacgacgggtcctgggcccagtctcgccctgactcacgcctccctccgcgtccggtctcctggacngtcagtccacctattcctccngaccacgtacggaaccagcgagtggtacgttggtagttactaacgttgtcgttcgtccgtacggtaacccaacgaaccacccgaggaaccaaaccgaccccctaatccatagtattacgtaggtacgtaccaacggtacggccgtccccgtcggtacccgggtcctacggtactaccggtcctttccgacgttccggtccttaccgtaaccggttgttacccggaacccgtaaaccgtccccgggtaccccttacccggtacccggtacccggttccgtttcccgggtcggtaccccgttcccggtacgggtaccgtttacgggaacgggttaccggtagggtaccggtacgttaaggttaaccgtttacggttacctacggtaacctcggttaccgtaacgtagttaccgggacggggtaaccgtaccggtacgggaacccgtttaaccggtttaggttttaaccggggttccgggttaacccgggggtacccgggtaaacccggggtaaccggtttaacccggtacccgggtttaaacccggggttaccccggttaaaccgggttttacccgaaccccggggacccgtttaaaccccggggaaacggtttcccccggtaaccccccgggtttacccccggtaaccggtttcccccgtttaacccccggg

SEQ ID NO: 174732 - DNA, 743 bp, Homo sapiens
  misc_feature: GYAE6OF02HCYCK.22.15.B04.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcgagggcacagggtcctgggcccagtctgccctgactcacgcctccctccgcgtccgggtctccgtggacaggtcagtcaccatcctccgtgcacgtggaaccngcaggtcgacgttggtgttaatactntgtctcctgtaccacaacaccagcaacgccccaacncatagtattagngacggtcacgtagccgcctacgacgggtcctgactcgtcttcgtcgtcgtacctcgtaacgtcgtcggacaaccgaccgtcccttcccgacgtacccgtcgtccgtcggtacctccggaggtccgtaggtaacggtacgtacggacggtacgtacgttaacttaacgtttacgtccggtactacggtaccttacgtaacgttagggtagggtaaccggtacgtaacgggtacggttaaaccgtttaaggggttttcggggtttaacgggtacccggggtaacggggtaaccggggaacccgttaaacgggtcccggttaacccgggtaacccgggtttacgggtaaccgggtacccgtaaccgggtaccccggtaaacgggtcccggtttacccccgggtaccccccgggtttacggtaccccgtttaacccccggg

SEQ ID NO: 174733 - DNA, 611 bp, Homo sapiens
  misc_feature: GYAE6OF02IWIQL.22.15.B04.1.454.CMB.1.raw
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
tcagacatacgcgtcacgaccggtgctcgatttagacagtatatatccgcgggggggggtctcaggaggcagcgctctcaggacgtcaccaccatggcctgggctctgctccctcctcagcctcctcactcagggcacgagggtcctgggcccagtctgccctgactcagcctcctccgcgtccggtctccgtggacagtcagtcaccactctccgtgcacgtggaaccngcagtgtacgtggtagtataactgtgtctctgtaccacaacaccgagacaacgcccaatcatgatttangagtcacgtacgcgccgtcgcggtcctgactcgtcttctcgtcgctacgacgtcgcgacacgtaccgtcctccgtacaccgtcctctcggctccgtaggcgtagaggngtcggngctagtagtttacttacgtcgacgtagtctaacgtcgtaagnggtacgacgacggacgttaacgttaagtttcgggtggttaccgggacggggtaacgtaccgtaaggttaccgtcggtaacccggttgttaaccgggtacgaaccggtacccggaacggttcccgtacccggtaccccggttccgtaccggttaccc

SEQ ID NO: 174734 - DNA, 686 bp, Homo sapiens
  misc_feature: GYAE6OF02F4WHV.22.15.B04.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (665)..(665): a, c, t, g, unknown or other
  misc_feature (665)..(665): n is a, c, g, or t
tcagacatacgcgtcacgaccggtgctcgatttagacagtatatatccgcgggggggggtctcaggaggcagcgctctcaggacgtcaccacagtggcctgggctctgctcctctcagcctcctcactcagggcactagggtcctcgggcccagtcctgccctgactcgacgccctccctccggcgtccggtctccgtggacngtcacgtccacctatccgtccagctacgtacggaacncggcacgtcgtacggtttggagttactaactctcgtctccgtaggtaaccaactaaccgccgtaaggacaaacccgtaccccaaatacgtagtacgtatttaacgtgtaccgtacgaacgtaccggccggaccgtccggacgggtccctagacttacgtcctttacgcgtcgacgtccgtagtctcggaaccaaccggaccggtcccttcggaccgtcccgttcgccggttacggtccgtaccgtcgtacgtacgggacgtaggacggtacggtacgttaagtacttaccgttacgtacgacgttacgacctagtactaaggtccggagacgtaacgcggtaacttagggttatcgggtccggaggaaccggtacgacgtccggtcgaccggttacgtacgtcggacccgtacgacgggttaccnccgggtaccctcggccctcgg

SEQ ID NO: 174735 - DNA, 654 bp, Homo sapiens
  misc_feature: GYAE6OF02HDJ06.22.15.B04.1.454.CMB.1.raw
  modified_base (117)..(117): a, c, t, g, unknown or other
  misc_feature (117)..(117): n is a, c, g, or t
  modified_base (230)..(230): a, c, t, g, unknown or other
  misc_feature (230)..(230): n is a, c, g, or t
  modified_base (474)..(474): a, c, t, g, unknown or other
  misc_feature (474)..(474): n is a, c, g, or t
tcagacatacgcgtcacgaccggtgctcgatttagacagtatatatccgcgggggggggtctcaggaggcagcgctctcaggacgtcaccaccatggcctgggctctgctccccctnagcctcctcactcagggcacgagggtcctgggcccagtctgccctgactcagcctccctcgcgtccgggtctccgtggactagtcagtcacatcctcctgcacgtcggaaccngtcagtgacgttggtgttatactatcgtctcgtgtaaccaacaaccaccaggaccaaaccgacccccaaactcatgttaattagtagacggtacaacgtacgcccggtacccgtacggtaccggggtccctaggtacgtccgttcctttacgtcgtcggtcctacgtacgtcgtacgaccaccgccgtacccgtcccgtcggtacctccgtcggtcggcctccgaggtactgggaacgtgtagngtactagttacgttatacgtgtcgacgtactagtagtcggtaggcgtcgacgtacgtacgttaggtttcgggtacggttcggacggacggtacgacggtcgtacggtccggtacgtacggaccgtaccggaaccggtccggtaccgtccccgtacccggtaccgttcctaccggttcccg

SEQ ID NO: 174736 - DNA, 728 bp, Homo sapiens
  misc_feature: GYAE6OF02F5N3N.22.15.B04.1.454.CMB.1.raw
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (378)..(378): a, c, t, g, unknown or other
  misc_feature (378)..(378): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctctcactcagggcacagggtcctggccagtctgccctgactcncgcctccgtccgcggtccgggtctctggactagtccagtcaccatctcncgcactcggaaccngactagtgacgttaggtaggtaactaacgtagttcgtctcgtacgtaaccaaacaaccaccgagtaccaaaccgtacccccaaaatcatacgtattagtacgtacgctaacgaagtccggtcctaggacgggtcctggtatcgtctcttcncgtcactacgtcgtcggaccaacgtcgtccctccgtacgtaccgtcctcggtcggtcctaccgtacgggtctaacgggaagtacggtacgggacggttctacgttaaatttaacgtaaccgttagtccgtaaacgtaccggttactaacggttaggtagggaaccgggacgaccggttaactaacgtttaaggggttttccgggacgggttacggggtaaccgggagggtaaacccgtcgggaaccgggttcgggttaccccttaccgggttaacggttaccgggtacggtaaccccgggtaagtccccggtacccccggtttacccgggtaaccgttcccgttacccgg

SEQ ID NO: 174737 - DNA, 669 bp, Homo sapiens
  misc_feature: GYAE6OF02IPHIK.22.15.B04.1.454.CMB.1.raw
  modified_base (361)..(361): a, c, t, g, unknown or other
  misc_feature (361)..(361): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccatctgccctgactcacgcctccctcgcggtccgggtctccgtggacagtcagtcacatctctgcacgtgaacagcagtgtcgttggtagttataactatgtctcgtagtaccaacaaccaccaaggacaaacgacccaaactcatgtaatttagtagacgtacaacgtaacgccggtaccgtcgacggggtcctagcgttccgtcttacncgtacggctaaccgtacgtcgtacgacaaccgaccgtccctaccctaactactacctcgtcggtctccgtagttacgaggtacgtacgttacttacttacgtacgtcgtacttacgtttacctttaaacggttcgtaccgtacctcgtacgttacgggtttcggtttacgggacggtacggaccgtaacggacgtacgtacccgttaccgtcggtacacgtacccgtaaacggtcctacccggtcccctaccggtaccgttaccgttcccgtttccgttaccccgtaccccttcccgtacgtacccgg

SEQ ID NO: 174738 - DNA, 569 bp, Homo sapiens
  misc_feature: GYAE6OF02IHDW4.22.15.B04.1.454.CMB.1.raw
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (343)..(343): a, c, t, g, unknown or other
  misc_feature (343)..(343): n is a, c, g, or t
  modified_base (502)..(502): a, c, t, g, unknown or other
  misc_feature (502)..(502): n is a, c, g, or t
tcagacatacgcgtcacgaccggtgctcgatttagacagtatatatccggcgggggtctcaggaggcagcgctctcaggcgtcaccaccatggcctgggctctgctcctcctcagcctctcactcagggcacaggtcctggccagtctgccctgactcagcctcctcgcgtcggtctcctggacaggtcagtcacatctcctgcactggaaccngcagtgacttgggtatactntgtctctgtaccanacnccagcaagcccaatcatcgattatgagtcactaagcggccctcgaggggtccctggactcgtactcgtctggctccaagtctcggctaaacncggccctcctcgaccgtctccgtgggtactccgaggctcggagtacttggacggtcttacggatttaacgttaaccgttcgcgttacctacagtacttcgacgtaggacgcgtaaactccgtttagggtcggttcggtcggtaggggaaccaggtaccncggaccgttacccgtggaaccgtcggacctacggaccttccggacccccttcggtcctaccgtccgg

SEQ ID NO: 174739 - DNA, 724 bp, Homo sapiens
  misc_feature: GYAE6OF02HBMUE.22.15.B04.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagacatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctcgcgttccggttctcctggacagtcagtcaccatcncctgcactggaaccngcagtcgacgttggtagttanaactntgtctactggtaccaacaacacccaggaccaaacgacccccaaactcactagatttaacgtgtaacggtacaactaacggccggaccctacgaggggtccctggactccgtacttctacgtcggtctaccaagtcgtacggactaaaccgaccgtccctacccgtacggtacccgttaccgtttcgcggggtaccgtacccgtagggtaccgtacgggtaagtacggttacgggacggtacgttaaggttaactttaacggttacccgttggaaccgtacggtaccttaacgaacgttagtcgggaacgtccgaacgtaccgtaaacggttacgttttgggtaccggttaacggggaccgggtaaccggggtaaccagggtaccgtaacggtacccggtttaccggtaaggtaccccgacgggtacccaacgggtcccgtacccggtacccccggttacggtacctacccgg

SEQ ID NO: 174740 - DNA, 817 bp, Homo sapiens
  misc_feature: GYAE6OF02H6277.22.15.B04.1.454.CMB.1.raw
  modified_base (226)..(226): a, c, t, g, unknown or other
  misc_feature (226)..(226): n is a, c, g, or t
  modified_base (398)..(398): a, c, t, g, unknown or other
  misc_feature (398)..(398): n is a, c, g, or t
tcagacatacgcgtcacgaccggtgctcgatttagacagtatatatccgcgggggggggtctcaggaggcagcgctctcaggacgtcaccaccatggcctgggctctgctcctcctcacgcctcctcactcgagggcacgagggtcctgggcccagtctcgccctgactcacgccctccctccgccggtccgggtcctccgtcggactacgtcgacgtccaacctntcctccgtgcacgtcggaaccaacgtagtacgacttaggtttcggttcttttacgcttcgttcggttccttaccgtacggtaaccaaaccaaccacccgaacgaccccaaaccccccatactactacttatttcgtaggtctaccgtaccgtccggtccgcctacgacggtnttccgtactcacgttccgtacttccacgtacgtcctacgtacgtccgtacgaaccgtaccgtacccgtcccttaaccctaacgtcgtccgtacggtcggtacctcggttagggtttacgacggtacgttaccgttacttaactttcgttacgtaccgttacgtttaaccgttttaacgttaacggtcggtaccctaccgttcgttacccggtttaggggttccgggtttccgggaaaccggtcggtaaacccggtaccggtttaacggtacccggtttacccgtaccggttaccggtaacccgggtccggtaaccggtaacccgggttccgttaccccccggttcccccggttacgtaaccccggtttccctaaccccggtttttcccccgacccccttaccccggttcgtacccccgg

SEQ ID NO: 174741 - DNA, 672 bp, Homo sapiens
  misc_feature: GYAE6OF02JNFCS.22.15.B04.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
tcagacatacgcgtcacgaccggtgctcgatttagacagtatatatccgcgggggggtctcaggaggcagcgctctcaggacgtcaccaccatggcctgggctctgctcctctcagtcctcctcactcagggcacgacgggtcctggcccagtctcgccctgactcgcgcctccctcgcgtccggtctccgtggacagtcagtcctacagtcctccngaccncgtacgaccagctagtcggtacgttggtagttactaactntcgtcctcgtacgacctaacacaccgtagaccaaaccaccccgtaactacctaagtgttaaacgttgtaggtacgaccgtaacgtaccggacccgtccctaacggtccggggtccctaggtactccgtcttccgtcgtacgtccttacgtacgtcgacgaccgaaacgccgtaccgtcgtccgaccgttccttacggcggtacctaaccggtgccgttaggtacggactacggtacgtccgtagttacttagttccgtagaccgtgtcgtatacgttagcggacgacgtcgtacaagtttcgttcggcggttaacggacggtaaccggacgtacggtaccgtacgtcccggtaaggtccgtaccgaccgtaccggtacgtccgtacccggcccttaggtcccgttaaccg

SEQ ID NO: 174742 - DNA, 880 bp, Homo sapiens
  misc_feature: GYAE6OF02JRZ85.22.15.B04.1.454.CMB.1.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
tcagacatacgcgtcacgaccggtgctcgatttagacagtatatatccgcgggggggtctcaggaggcagcgctctcaggacgtcaccaccatggcctggctctgctcctcctcagcctcctcacgtcagggcacacggtcctcgggcccagtctcgcccttagactcagtccctcccgtcgacgtcccgggtntccgtaggacacgtcacgtcaccgacttcncctgcctacgtcggaaaccngactgtacgtacggttggttagttaataaaccgttntcgttccttccgtaggtaacccaacgtaaccgtaacccgaggaacccgtaaaaccgaccccccgtaaaactacgtacgtacggttaactttaacgtacggtaaccggttactaaccgttaaacggccccgggttacccgttaaccggtacgggggttaccccttaaggaacccgttacccggttccgttttaccgtaccggtttccggggtaccctttaaccggtaaacgggttccgtacggggtaaaaaccctaacccgggttaccccgggttaccccgttttaacccccggacggtttaccccggttaaccggtccggtttaacccgggtacccgttacccgggtaacggttaccgttaccgggtaagggttaccgttacgggtaccgttacgttacggttaacgttaacgttaccgttacgtaccgtacgttacgtacgtaacgttacgtacgggtacggtaccgtacgtacgtaacgtttacgtttacggtacggttacgggtaccggtacgtaccgtaaggtccggtaacggaccgttcggtaaccggtccgaccgtacggtacgtaccgtccgtacccgtaccggtcttaccgg

SEQ ID NO: 174743 - DNA, 701 bp, Homo sapiens
  misc_feature: GYAE6OF02HXCRE.22.15.B04.1.454.CMB.1.raw
  modified_base (118)..(118): a, c, t, g, unknown or other
  misc_feature (118)..(118): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
  modified_base (461)..(461): a, c, t, g, unknown or other
  misc_feature (461)..(461): n is a, c, g, or t
tcagacatacgcgtcacgaccggtgctcgatttagacagtatatatccgcggggggggtctcaggaggcagcgctctcaggacgtcaccaccatggcctgggctctgctcctcctcanccctcctcactcgagggccacgacgggtccgtgggccctagtctcggccctgactcacgccctccctccggccgttccggtctcctggactagtcngtcacctntctcngccacgtcgacagctagtggacggttggttagtactaacgtntcgtccttcgtacgtacaacacaccgagacaaccgaccccaactctatacgtattacgngtagtctaacgtacaccggcctcggtaccggtcctgacgtcgtccttcgccgtcgtaccgtctaacggtcacgtccaacgtcccgtcctacgccgtcgtcgtcgtcgtccgacgtgcgtgcgtagtcgtcgtntacgttattacgttactcgtacgtaccgtctaacgtgttacgcggtaaacggcccgggtagaaccggtttaacggttacgggtttccgggttacggggtttacccggggaagggttaaccccggttacggtaaccgttccgggtaaaccgggttacccgtccggtttaaccggacccggttcccgtaacccgtaccggtcgtttaacccccccgggtccgtccggttaccccgttacccg

SEQ ID NO: 174744 - DNA, 803 bp, Homo sapiens
  misc_feature: GYAE6OF02GWKYM.22.15.B04.1.454.CMB.1.raw
  modified_base (627)..(627): a, c, t, g, unknown or other
  misc_feature (627)..(627): n is a, c, g, or t
  modified_base (780)..(780): a, c, t, g, unknown or other
  misc_feature (780)..(780): n is a, c, g, or t
tcagacatacgcgtcacgaccggtgctcgatttagacagtatatatccggcggggggggtctcaggaggcagcgctctcaggacgtcaccaccatggcctgggctctgctcctcctcagcctcctcactcagggcacgacggtcctggcccagtctcggccctgacctcgacgtccctcccgtccgccggtccggtctccgtgactgtcagtccaacactcctcgtcgacgtaaccgtacggaaccagacgtacggtacgtacgggttttggtaacgtttaaactaacgttacgttcggttaccgttcccggtaacggtaaacccaaacaaaccccgtaaccgtaaacggtaacccaaaacccggaacccccctaaagaccttacgtaacgtaacgtttaagtaccggtaacctaaccgtaaacggtaaccggtccccgaccggttacggaaccgggtcctaacgtaacgtccgttctaccgtacgtacgtaccctaggtaacggttacgacgtaacaccggtaaccgtccgtaccgtcggtaccgtcctacggtacggtacctaccgcggacgttaacggacggtaacgcggtaacgttcgttaaactacgtttaaagtccgggtnaaccgtacgtaacgtaacgtaagtacggaacggttaccggaagtttaacccgaagtttaacgtacggtttcggggtacgttaaacggggacgtaacggacgttacgacccggttaccggaacgttcgaaccgtcgaccgacgacgttaccccnccggtttacctacggcctacccg

SEQ ID NO: 174745 - DNA, 715 bp, Homo sapiens
  misc_feature: GYAE6OF02IDCN1.22.15.B04.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
  modified_base (472)..(472): a, c, t, g, unknown or other
  misc_feature (472)..(472): n is a, c, g, or t
tcagacatacgcgtcacgaccggtgctcgatttagacagtatatatccgcggggggggtctcaggaggcagcgctctcaggacgtcaccaccatggcctgggctctgctcctcctcagcctcctcactcaggcacagggtcctgggcccagtctcgccctgactcgacgccctccctccgcggtccggtctcctggacngtcagtcaccntctccgtgcacgtggaacncgcaggtgtacgttggtagttaataactntgtcctcgtacgtaaccaacacctaccgaggaaccaaaccgtaccccctaaaatccgtaatgtaacgtttacgacggtacggtactaacgtacggcccggtcccgtcggtaccgggtccctagtcgtaccgtccttcgtacgtccggctaccgtagtcagaccaaccgtccgtacctcccgtcgtaccgtcttccggcggtccacgtcggtacnggagtagttcggacgtagttcggttaatttacgtaccggttacactaagtccgtaaagacttacggggtagtaccgggtacaacgggtacgttaaacggttagggttttcgggtacgggtaccggggtacgggtaaccggaccggtaacggttcccggtaccggaaccgtttacgggccgttaccgaaccgtaccggtaccggtccccgttaccccgttacccgggttacctacgttaccccg

SEQ ID NO: 174746 - DNA, 518 bp, Homo sapiens
  misc_feature: GYAE6OF01EHNUG.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctccagactcctcatccacaatatattctacagggccgcgggcatcccagacaggttcagtggcagtgggtctgggacagacttcactctcaccatcaaacagactggacgcctagaagtattttgactaatgttattactgtcagtacaatatgcctccacccccgactccaccgttcggaccaacgggacacgactgcagatagaaacgactggtgctgcacatctctctctac

SEQ ID NO: 174747 - DNA, 511 bp, Homo sapiens
  misc_feature: GYAE6OF01DK9ZS.21.33.C11.1.454.CMB.1.raw
  modified_base (496)..(496): a, c, t, g, unknown or other
  misc_feature (496)..(496): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtgcagtggtctgggacagacttcactctcacatcagcagactggagcctagaagtattttgactaatgtattactgtcagtctaatatgtactcccacccccgatccaccgttcggaccaaggacacgactgacagatagaaacgactgtgcncgcacatctgtcttc

SEQ ID NO: 174748 - DNA, 589 bp, Homo sapiens
  misc_feature: GYAE6OF01CGB9A.21.33.C11.1.454.CMB.1.raw
  modified_base (244)..(244): a, c, t, g, unknown or other
  misc_feature (244)..(244): n is a, c, g, or t
  modified_base (433)..(433): a, c, t, g, unknown or other
  misc_feature (433)..(433): n is a, c, g, or t
tcagtcgtcgctcgcacgaccggtgctcgatttagagtgagctcgttgggtttgggggagaagagctgctcagtcaggacccagagggaaccatggaaacccagcgcagcttctcttcctcctgctactctggctccagaaaccaccggagagattgtgttgacgcagtctccaggcaccctgtctttgtctccaggggacagacgccaccctctcctgcggggccagtcaaattgttacccgngactacttagcctggtaccagcagaaacctggccaaggctcccagactcctcatccacaatatattctacaggccgcggcaagtcccagaccaggttcagtggcagtggtctgggacagactcactctcaccatcagccagactggagcctagaagtattttagactaatgtattactgtcagcaatanacgctaccacccccgtatccgtaacccttccggacccgaaacggggaccaaccggactacggacctaaggaacgttaacggaaaaccgtaaacgttcggtacggtacccgttacgggaccctaacccaactttccgttcggttacccttttacccg

SEQ ID NO: 174749 - DNA, 503 bp, Homo sapiens
  misc_feature: GYAE6OF01EVZ8L.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctccagactcctcatccacaatatattctacagggccgcgggcatcccagacaggttcagtggcagtggtctgggacagacttcactctcaccatcagcagactggagcctgaagtatttgcaatgtattactgtcagcaatatgctccacccccgatccaccttcggccaagggacacgactgcagatgaaacgaactgtggctcgcacatctgtcttac

SEQ ID NO: 174750 - DNA, 526 bp, Homo sapiens
  misc_feature: GYAE6OF01CS8NH.21.33.C11.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgcggggccagtcaaattgtacccgcgactacttagcctggtaccagcaagaaacctggccaggctcccagactcctcatccaacaatatattctacagggccgngggcatcccagacaggttcagtggcaggtgggtctgggacagacttcactctacaccatcagcagacgtggagccgtgaagtattttgactaatgtaattactgtacagactaatatcgcctaccacccccgtatcctaccttccggacaacggacacgactgacagagtagaaacgactgcgctacgcacatctgtctac

SEQ ID NO: 174751 - DNA, 513 bp, Homo sapiens
  misc_feature: GYAE6OF01A4PFS.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtattttgactaatgttattactgtacagcaatatgctcacccccgatccacccttcggaccaagggacacgactgcagagtcgaaacgaactgtggctgccaccatctgtcttc

SEQ ID NO: 174752 - DNA, 508 bp, Homo sapiens
  misc_feature: GYAE6OF01B0TBH.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcacatcagcagactggagcctgaagtattttgactaatgtattactgtcagcaatatgctcaccccgtatcctaccttcggaccaacggacacgactgcagagtagaaacgactgtgctacgcacatctgtctac

SEQ ID NO: 174753 - DNA, 514 bp, Homo sapiens
  misc_feature: GYAE6OF01EF0X8.21.33.C11.1.454.CMB.1.raw
  modified_base (499)..(499): a, c, t, g, unknown or other
  misc_feature (499)..(499): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtatttgactaatgtattacttgtacagacaatatgctccacccccgatcctaccttccggaccaagggacacgactgcagatagaaacgactgtcgcncgcaccatctgtctc

SEQ ID NO: 174754 - DNA, 515 bp, Homo sapiens
  misc_feature: GYAE6OF01D0N9A.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctggggacagacttcactctcaccatcagcagactggagcctgaagtattttgctaatgtattactgtcagacaatatgctccacccccgatcctaccttcgaccgaacgggacacgactgcagagtacgaaacgaactgtgctcgcacatctgtcttac

SEQ ID NO: 174755 - DNA, 531 bp, Homo sapiens
  misc_feature: GYAE6OF01BQOFW.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagacctcctcatccacaatatattctacagggccgcgggcatcccagacaggttcagtggcagtgggtctgggacagacttcactctcacatcagcagactggagcctagaagtattttgactaatgtattactgtacagacaatatgctccacccccgtactcctaccttcggaccgaacgggacaccgactcgcagacgtacgaaacgaacgtcgtaggactcgacaccatctgttcttaccg

SEQ ID NO: 174756 - DNA, 516 bp, Homo sapiens
  misc_feature: GYAE6OF01CRSEN.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacaggccgcgggcatcccagacaggttcagtggcaggtgggtctgggacagacttcactctcacatcagcaggctggagcctgaagtattttgactaatgttattactgtcagtcaatatgctccacccccgtatcctaccttcggaccaaggacacgactgcagatacgaacgaacgtgacgctacgcaacatctgtcttacg

SEQ ID NO: 174757 - DNA, 740 bp, Homo sapiens
  misc_feature: GYAE6OF01AZCMW.21.33.C11.1.454.CMB.1.raw
tcagtcgtcgctcgcacgaccggtgctcgatttagagtgagctcgttgggtttgggggagaagaggcgtgctcgaggtcaggacccagagggaaccgatggaaaccccagcgcagcgttctcttcctcctgctactctggcctcccagaaaccaccggagagattgtgttgacgcagtctccaggcaccctgtctttgtctccaggggacagacggccaccctctcctggccggggccagtcaaattcgtacccgcgactacgttacgcctggtaccagcagaacctggccaggctccagacctctacatccacaatatacttactaccgagggcccgacgggtctaactccccgaagtacctaggttcaaggtcggccgtaggtcggggtactaggggacctagtacttccgacgttcctaccaaccgtagtccgaacgaccaacggtacctacgggtaccgtacccgtaggtaaacgttagttttacgggactaaacgttggttaactttacgtacggtaccgtaggtaccgtaagttacgtacggtaccttacccgtaaccccccgtatttacccgtaacccgtttaccgggtacccgttaaacggggttacctaaccggtaaccgttacggaccgtaacggtaacgtaaccggtaaaacccggtaaccgttcgggtacggaccgttaccggaacccgtaacccgtaaccgttacccgttagttcccgtttaacccg

SEQ ID NO: 174758 - DNA, 568 bp, Homo sapiens
  misc_feature: GYAE6OF01C49MT.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctggcggggccagtcaaattgtacccgcgactacttagcctggtaccagcagaaacctggccaggctcccagactcctcatccaacaatatattctacgaggccgcggcatccccagactaggttcagtggcaggtggtctgggacagacttcactctcaccatcagcagacgtggacgcctagtaagtattttagactaagtagttacttactgtacagtactaatatcgcctacccaaccccccgtatccctaccgttacccggacgaacgggaccaacggactcgacaagaacgtaacgaaacgtacgtggtacggctcgtacccaacctatcgttcgtctttacc

SEQ ID NO: 174759 - DNA, 517 bp, Homo sapiens
  misc_feature: GYAE6OF01ELA7W.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtattttgacaatgtattactgtcagacaatatgctccacccccgatccaccttccggaccaagggacacgactcgcagagtagaaacgaactcgtaggctcgcacatctgtcttacg

SEQ ID NO: 174760 - DNA, 538 bp, Homo sapiens
  misc_feature: GYAE6OF01D4EZ9.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattcgtacccgcgactacttagcctggtaccagcagaaacctggccaggctcccagactcctcatccacaatatattctacagggccgcgggcatcccagacaggttcagtggcagtgggtctgggacagacttcactctacaccatcagcagactggagcctagaagtattttgactaatgttattacttgtcagtactaatatgcctccaacccccgtactacctacccgttaccggaccgaacgggaccacgactgcagagtacgaaacgacgtgtacggctcgcaccatctgtcttacg

SEQ ID NO: 174761 - DNA, 591 bp, Homo sapiens
  misc_feature: GYAE6OF01AQA5C.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgcggggccagtcaaattgtacccgcgactacttagcctggtaccagcagaaacctggccaggctcccagactcctcactccacaatatattcacagggccgcgggcatcccagacaggttcagtggcaggtggtctgggacagacttcgactctcaccatcagcagacgtggacgcctagaagtatttgactaatgttattacttgtacagtactaatatcgtacctcccaacccccgtactacccgtacccgtttaccgggaacccgtaacgggacctaaccggtaacctcggaccgtaaggtaacgtaacgaaaccgtaacgttcggtacggtacgtacgtaccaccgtacttccgttcgttccgttacc

SEQ ID NO: 174762 - DNA, 510 bp, Homo sapiens
  misc_feature: GYAE6OF01DFCMC.21.33.C11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtgagctcgttgggtttggggggagaagagctgctcagtcaggacccagagggaaccgtggaaaccccagcgcagcttctcttcctcctgctactctggctcccagaaaccaccggagagattgtgttgacgcagtctccaggcaccctgtctttgtctccaggggacagagccaccctntcctgcggggccagtcaaattgttacccgcgactactagcctggtaccagcagaaacctggccaggctcccagactctcatccacaatatattctacagggccgcgggcatcccagacaggttcagtggcagtggtctgggacagacttcactctcacatcagcagactggagcctagaagtattttgctaatgtattactgtacagcaatatgctccacccccgatccaccttcggaccaacgggacacgactgcagatagaaacgatgtgctgacaccatctgtcttcgtac

SEQ ID NO: 174763 - DNA, 528 bp, Homo sapiens
  misc_feature: GYAE6OF01DQ47V.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctccagactcctcatccacaatatattcacagggccgcggcatcccagacaggttcagtggcagtgggtctggggacagacttcactctcaccatcagcagactggagcctagaagtattttagactaattagttattacgtgtacagtacaatatcgctccaacccccgatcctaccgttacgaccgaacggaccacgactcgacagacgtacgaaacgactgacgctgacacatctgtcttacg

SEQ ID NO: 174764 - DNA, 541 bp, Homo sapiens
  misc_feature: GYAE6OF01EG9XY.21.33.C11.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagagtgagctcgttgggtttggcgggagaagagctgctcagttaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaacctggccaggctcccagactcctcatccacaatatattctacgagggccgcgggcatcccagacaggttcaggtgcagtgggtcnggggacagacttcactctcaccatcagcagacgtggacgctagaagtattttgactaatagtaattactgtacagactaatatcgtctaccacccccgtatcctaccttccggaccgaacggaccacgactcgcagtagtacgaaacgaacgtcggacggtctacgccaacctatctgtcttac

SEQ ID NO: 174765 - DNA, 536 bp, Homo sapiens
  misc_feature: GYAE6OF01BDFB2.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcaggtgggtctggggacagacttcactctcaccatcagcagactggacgccgtagaagtattttagactaattgttattacttgtcagactaatatgactccacccccgactcctaccttccggaccaacgggaccacgactacgcagagtacgaaacgacgtgtcggctcgacaccatctcgtcttcc

SEQ ID NO: 174766 - DNA, 515 bp, Homo sapiens
  misc_feature: GYAE6OF01DTV4C.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcacatcagcagactggagcctgaagtattttgactaatgtattactgtcagacaatatgctccacccccgtactcctaccgttcggaccaacggacacgactgacagacgtagaaacgactgcgctcgcacatctgtcttc

SEQ ID NO: 174767 - DNA, 540 bp, Homo sapiens
  misc_feature: GYAE6OF01ANNVG.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagacctcctcatccacaatatattctacagggccgcgggcactcccagacaggttcagtggcaggtgggtctgggacagacttcactctcacatcagcagactggacgcctagaagtatttagactaattgtattactgtacagactaatatcgcctacccacccccgtactacctaccgttccggaccgaacgggaccacgactcgacagacgtacgaaacgacgtgacgctacgacactatctgtcttacg

SEQ ID NO: 174768 - DNA, 559 bp, Homo sapiens
  misc_feature: GYAE6OF01B0WWD.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctaacgagggccgcgggcatcccagacaggttcagtgcagtggtctgggacagacttcactctcaccatcagcagactggagcctagaagtattttagactaattgtactttactgtacacgtactaaatatcgacctaccgaaccccccgtatccctacccgttcggaccgaacgggaccgaccgactcgacagaacgtacgaaacgtaacgtgtacggcgtacgaccaacctatctgttccttacg

SEQ ID NO: 174769 - DNA, 592 bp, Homo sapiens
  misc_feature: GYAE6OF01BNZH6.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctcaggcacctgtctttgtctccagggacagagccacctctcctggcggggccagtcaaattcgttacccgcgactacttagcctggtaccagcaagaaacctggccaggctcccagacctcctcatccaactaatattattctacgaggccgcggcactcccagacagttcagtgcagtggtctgggacagctcactctacaccatcagcagactggatccgtagaagtatttgactaagttgttaattacttagtcaagtacaaattacgtcgtaccgtaccctaaccccccggtatacccgtacccgtttacccgggaacctaacggggaaccaacccggactacgacgaacgtaacgtacgtaaacgacgttggtacggtcctacggtacctaccgtagttccttcgtctttacccg

SEQ ID NO: 174770 - DNA, 524 bp, Homo sapiens
  misc_feature: GYAE6OF01BVOVM.21.33.C11.1.454.CMB.1.raw
  modified_base (507)..(507): a, c, t, g, unknown or other
  misc_feature (507)..(507): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcacatcagcagactggagcctgaagtatttgctaatgtattactgtcagacaatatcgctccacccccgactcctacccgttcggaccgaacgggaccacgactcgacagagtacgaaacgacgtgtacgcngacacatctgtcttacg

SEQ ID NO: 174771 - DNA, 543 bp, Homo sapiens
  misc_feature: GYAE6OF01D7XIX.21.33.C11.1.454.CMB.1.raw
  modified_base (522)..(522): a, c, t, g, unknown or other
  misc_feature (522)..(522): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctggcggggccagtcaaattcgtacccgcgactacttagcctggtaccagcaagaaacctggccaggcctccagactcctcatccacaatatattctacgagggccgcggcactcccagacaggttcagtggcaggtgggtctgggacagtacttcactctcaccatcagcagactggacgccgtagaagtatttgactaatgttattacgtgtacagtacaattatcgcctccaacccccgtatacccgtacccgttcggaccaacgggacaccgactcgacagacgtacgaaacgatcgngcacgacacatctgtcttacc

SEQ ID NO: 174772 - DNA, 534 bp, Homo sapiens
  misc_feature: GYAE6OF01A9WK5.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcggcatcccagacaggttcagtgcagtgggtctgggacagacttcactctcaccatcagcagactggacgcctgaagtatttagactaatgtattactgtcagacaatatcgcctccacccccgtatacctaccgttccggaccgaacgggaccaccgacgtgacagacgtacgaaacgacgtgtacggctacgaccaccatctgtcttacc

SEQ ID NO: 174773 - DNA, 549 bp, Homo sapiens
  misc_feature: GYAE6OF01BEJ86.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgtacccgcgactacttagcctggtaccagcagaaacctggccaggctcccagactcctcatccacaatatattcacgagggccgcggcactcccagacaggttcagtgcaggtggtctgggacagcttcactctcaccatcagcagactggagcctagaagtatttgactaatgtattactgtcagcaatatcgtcctccaccccccgtatccctacccgttccggaccgaacgggaccaacggtacctcgacacgagtacgaaacgtaacgtcggtacggtccgtacgccacatcgttagtccttaccg

SEQ ID NO: 174774 - DNA, 539 bp, Homo sapiens
  misc_feature: GYAE6OF01C0Y8E.21.33.C11.1.454.CMB.1.raw
  modified_base (246)..(246): a, c, t, g, unknown or other
  misc_feature (246)..(246): n is a, c, g, or t
  modified_base (519)..(519): a, c, t, g, unknown or other
  misc_feature (519)..(519): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgtacccgngactacttagcctggtaccagcagaaacctggccaggctccagactcctcatccacaatatacttctacacggccgcggcactcccagacaggttcagtggcagtgggtctgggacagactcgactctcaccatcagcagactggagcctagaacgtattttgactaattgtacttactgtacagactaatatcgtacctacccgacccccgtactaccctaccgttaccggaccgaacggacacgactcgacgagatacgaacacgtcgcgntcgaccacatctgtcttacg

SEQ ID NO: 174775 - DNA, 562 bp, Homo sapiens
  misc_feature: GYAE6OF01BP15Z.21.33.C11.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtgcagtgggtctgggacagacttcactctcacntcagcagactggagccgtgaagtatttgactaatgtattactgtacagacaattatgcctacccaccccccgtatccctaccgttccggacccgaacgggaccaaccgacgtcgaccgaagacgtacggtaaacgaacgttggacggtcctacggaccaaccctatccgttcgttccgttacccg

SEQ ID NO: 174776 - DNA, 576 bp, Homo sapiens
  misc_feature: GYAE6OF01EP7YP.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctacacatcagcagactggagcctagaagtatttgactaattgtattacgtgtcagactaattatgtcctacccaaccccccgtataccctacccgtttaccggacccgaacgggaccaaccggtacgtacgaccgaagtaacgtacggaaaaccgtaacgtcggtacggacgtacgccaaccctattccttcggtcttacccg

SEQ ID NO: 174777 - DNA, 581 bp, Homo sapiens
  misc_feature: GYAE6OF01COMKZ.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaaacctggccaggctcccagacctcctcactccacaatatattctacgaggccgcgggcactcccagacaggttcagtgcagtggtctgggacagcttcactctcacatcagcagactggacgctagaagtatttcgactaatgttacttacgttgtacagactaaatgtcgtctcccaaccccccgtacttaccctacccgttccggaccgaacgggtaccaaccggtacgtacgaccgaagtaacgtaacggaaaccgaacggttcggtacggcgtacgaccgaacctattccttcgttcctttacc

SEQ ID NO: 174778 - DNA, 725 bp, Homo sapiens
  misc_feature: GYAE6OF01EK596.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctccgtggcggggccagtcaaattcgtacccgcgactactagcctggtaccagcagaaacctggccaggcctcccagacctcctcactcccaactaatacttacttactaccgacggggcccgcgggaccaactccccgaaggtacgtaaggtttccaaggttcgggacctagggttcggggttcctagggggaactacggtacctttccaaccgttctaccaaccgtattccaaggtccaaggtacgtacgggacgtaccgtaggtaaaggttacttttacggactaagttacgttaacgtttaacgtgttacgacgtactaaattactacgtaccttacccgaaccccccgtactacccgtacccgtttacccggaacccgtaacgggtaaccgaaccgtaaccgtacgaccgtaacggaacgtaaacggaaaaccggtaacgttaccgggtacggtaccgtaccgtaccgtaacccgtacgttaccgttcgttccctttaaccg

SEQ ID NO: 174779 - DNA, 545 bp, Homo sapiens
  misc_feature: GYAE6OF01A7Y2X.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgttactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcactccacaatatattctacagggccgcgggcatcccagacaggttcagtggcaggtggtctgggacagacttcactctcaccatcagcagactggacgcctagaagtattttgactaatagttaacttactgtcagtactaatatcgcctaccaccccccgtatccctaccttaccggaccgaacgggaccacgacgtgacgagatacgaaacgtacgtggtcggctgacacactctcgtcttctacc

SEQ ID NO: 174780 - DNA, 546 bp, Homo sapiens
  misc_feature: GYAE6OF01BY7CY.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaaacctggccaggctcccagactcctcatccacaatatattctacgagggccgcgggcatcccagacaggttcagtggcagtgggtctgggacagacttcactctacaccatcagcagactggacgcctagtaagtattttagactaagtagtattactgtacagtacaatatcgctacccacccccgtatacctaccgttccgaccgaacgggaccacgactcgacaagacgtacgaacgacgtcgtcggactcgacaccagtctcgtcttacc

SEQ ID NO: 174781 - DNA, 541 bp, Homo sapiens
  misc_feature: GYAE6OF01C8K73.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggcctcccagactcctcatccacaatatattctacagggccgcgggcactcccagacaggttcagtggcagtgggtctgggacagacttcactctcaccatcagcagactggacgcctagaagtattttgactaatgtattactgtacagtactaatatgctccacccccgtactcctaccgttccggaccgaacgggacaacgacctcgaccgagacgtacgaaacgaacgtcgtacgctcgacaccatctgtcttacc

SEQ ID NO: 174782 - DNA, 541 bp, Homo sapiens
  misc_feature: GYAE6OF01CVYGL.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccaccctctcctgcggggccagtcaaattcgttacccgcgactacttagcctggtaccagcagaaacctggccaggcctcccagactcctcactcccaacaatactattctacgacgggcccgcgggcactcccagacaggttcagtggcagtgggtctggggacagacttcactctcaccatcagcagacgtggacgcctgaagtattttgactaatgttattactgtcagactaatatcgctaccacccccgatccgtaccgtcgaccaagggacacgctagacagagtacgaaacgtacgtgtacgactacgccacattctgtcttacg

SEQ ID NO: 174783 - DNA, 792 bp, Homo sapiens
  misc_feature: GYAE6OF01D25OA.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccctaccctctccgtggccggggcagtactaaagttcgtacccgcgactacttacgccgtacggtaccaggaccaacggaaaaccgtcgggacccgaacggtcccttaccccgaagtacccttaccctaccaacttaccccaaactaaacttaacttactttaccgtaaccggacggggcccgaccggggaccaaccgttaccccgaaggaacccgttacgggttacgaacggttcgggacgtaacgggttcggggtacgtacgggggaacctaaggtacccgtttaccaccgtttccacctaaacccagttaccgaggtaccaacggtacgttagggacgtaccgtaggtaaacgttagttttagacctaattagttaacttagttcgtacctaagtaccttaaagttactacggtacccttacccgaaccccccgtactacccgtacccgttaccggaaccgaaacgggaaccgtaaccgaccgttaccggaacgtaacggtaacgtaaccggtaaaaccgtacggttacggttacggaccgttacgtaccctaacgtacttccgttacgttccttacccg

SEQ ID NO: 174784 - DNA, 563 bp, Homo sapiens
  misc_feature: GYAE6OF01DHIM1.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgtacccgcgactacttagcctggtaccagcagaaacctggccaggctcccagactcctcatcccacaatatattctacagggccgcgggcatcccagacagttcagtggcaggtgggtctgggacagacttcactctcaccatcagcagactggacgcctagaagtatttgactaatgtattactgtcagctaatactgtcctacccaaccccccgtacttaccgtacccgttaccggacccgaaacgggaccaacgacctcgaccagacgtacggaaaacgtacgtggtacggctacgtaccaacctagtcctgttcttaccg

SEQ ID NO: 174785 - DNA, 710 bp, Homo sapiens
  misc_feature: GYAE6OF01B52NH.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctccgtggccggggccagtctaaattcgttacccgcgactacttagcctggtaccagcagaacctggccaggcctcccagactcctcactccaacaatatacttctacgacggccgcgggcacgtcccagacaggttacagtggctaggtggtctggggacagtactcactctacacatcagacgagacgtggacgtccgtagtaacgtattttcgaacttaacgttagttaacttacgttagtacgtagtacgtaaattacgttacgtacccttaccccgaaccccccgttacgttacccccgttacccggtttacccgggaacccgtaaaccggggtaaccctaaccccgggtaaccgttaccggtaaccgtaaacggtaaaaccgtttaaaacccggtaaacgttaccgggttacggtaacccgttaccggtaaccccgtaaccgtaaccgtttacccggttacgtttacccgttacccgtttaaccccg

SEQ ID NO: 174786 - DNA, 564 bp, Homo sapiens
  misc_feature: GYAE6OF01CDW6V.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtggtctgggacagacttcactctcaccatcagcagactggacgcctagaagtattttcgactaagttgttacttacttgtacagtactaatactcgctacccacccccgtatcctaccgttccggaccgaacgggccaacgactcgaccgtagacgtaacggaaacgtacgtacggtacgtacgtacgaccaacctattcgttgttccttaccg

SEQ ID NO: 174787 - DNA, 780 bp, Homo sapiens
  misc_feature: GYAE6OF01DOLAY.21.33.C11.1.454.CMB.1.raw
tcagtcgtcgctcgcacgaccggtgctcgatttagagtgagctcgttgggtttggggggagaagagctgctcagtcaggacccagagggaaccataggaaaccccagcgcagcttctcttcctcctgctactctggctccagaaaccaccggagagattgtgttgacgcagtctccaggcaccctgttctttgtctccgagggacagacgccaccctctcctggccggggccaagtacctaaattcgttaacccgcgtacttacttacgccgtggtaaccagacaacgaaaaccgtggaccaaggcctacccacgactcctcactaccaactaaatactactttacaacgacggggcccgagggccaaacttccccgaagacgtacgggttacctaagggttcgggacctaaggttcggggtacgttacgggggaactaacggtaccctttaccgaacccgtttaccttaccgaaacccctaagttacccgaaacggtaccgaaacggtaaccgttacggggaacggtaccccgttaacggttaaaggttaacggttttttaacggaaccgtaaaagtttagtttaaacgttaaccgtttaggtaaccgtaacggtaacctaaagtagtttaccgacctaccccgtaacccccgtacctacctacccgttaccggaccggtaaacgggaacgaaccgacgttacgaccgaacgtaacgtaacgaaaacgtaacgttggtacggcttacgaccgtaactacttacctggttcctttaaccg

SEQ ID NO: 174788 - DNA, 541 bp, Homo sapiens
  misc_feature: GYAE6OF01ESE9L.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattcacagggccgcgggcactcccagacaggttcagtggcagtgggtctgggacagtacttcactctcaccatcagcagactggacgcctagaagtatttagctaatcgtattactgtacagacaattatcgactcccaaccccccgtatccctaccgttccggaccgaaacgggaccaacgactgacagagtacgaaacgtacgtgtcggctacgacaccattcgtgtctac

SEQ ID NO: 174789 - DNA, 632 bp, Homo sapiens
  misc_feature: GYAE6OF01BG0F4.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagcccaccctctcctggcggggccagtcaaattcgtacccgcgactactagcctggtaccagcagaacctggccaggcctcccagacctcctcactccaacaatatattcacgacgggccgcgggcactcccagacaggttcagtggacaggtgggtctggggacagacttcactctcacctatcagcagacgtggacgccgtagaagttatttagactaaagtgttaattacgtcgtacaagtacctaaattactacgtaccctaacccgaaccccccgtaacttaccccgtaacccgtttaccgggacccgtaaacggggacctaaccggtaccgtacgacgaacggtaacgtaacggaaaaccgtaaccgtacggtacggacctacggtaccctaaccgtacttccgttcgtttccttaccc

SEQ ID NO: 174790 - DNA, 822 bp, Homo sapiens
  misc_feature: GYAE6OF01CI8FO.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccacctgttcttgtcctccgagggacagacgccacctctccgtggcgggccagtactaagttcgtaccgacgtacttacgtacgccgtaggtaccagacaacgtaaccgtcggaccacggtccctacccgagtacccttcctacaacctaccaaactaaattaacttactttacccgaacggaccgggcccggaccgggacctaccgtaccccgaaggtaccgtaggttacgaacggtcgggacgtaagggttcgggtacggtacgggaacacggttaccttccgtacctcctaccaacctaacgtacgaacgtaccgtaacggtacgtacgggacgtaccgtaaggaaacgtttttttttttagacgtaacgttaagttacgtttaacgtttaacgtacgttaacgtaacggtaactaaacgtttacgtacccgttaccccgttaaccccccgtaaaccccccgttaccttaacccccgtaacccggtttaccccgggaaacccgggtaaaccgggaacccgtaaacccggtaccgtacgaaccgtaaggtaaccgtaaacggtaaaaccggtaacggttcgggtaccggtaccgtacggtaacccctaacgttacgttaccgttccgtttccgttaacccg

SEQ ID NO: 174791 - DNA, 551 bp, Homo sapiens
  misc_feature: GYAE6OF01DK0XW.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctggcggggccagtcaaattcgtacccgcgactacttagcctggtaccagcagaaacctggccaggcctcccagactcctcactccacaatatattctacgacgggccgcgggcactcccagacaggttcagtggcaggtcgggtctgggacagacttcactctcaccatcagcagactggagccgtgaagtatttgactaagtgtacttactgtcagactaatatcgtactaccctacccccgtatcctaccgttccggaccaacgggaccacgactcgacagacgtacgaaacgacgtggtcgcgtagaccactattctgtcttaccg

SEQ ID NO: 174792 - DNA, 642 bp, Homo sapiens
  misc_feature: GYAE6OF01CGMG6.21.33.C11.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgctccgagggacagacgccaccctctccgtggcgggccagtcaaattcgtacccgngtactactagcctaggtaccagcaagaaacctggccaggctcccagacctctcatccaacaatatatctacgaggccncggcatccagactaggttacaggtgacaggtggtctagggacagtacttcactctcacatcagcagactggacgcctagaagtatttacgactaaagttgttaacttacgtacgttacaaggtaacctaagttaacgtaccgtaccgttacccccgaaccccccgtagtaccccgttaacccggttaccgggaacccgtaaacggggtacctaaccggtaccgtacggacgaaacgtaacggtaaacggtaaaacccggttaacgttggaacggtctacggaaccctaactacgttaccgttcgttccgttaacccg

SEQ ID NO: 174793 - DNA, 683 bp, Homo sapiens
  misc_feature: GYAE6OF01D33DZ.21.33.C11.1.454.CMB.1.raw
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
tcagtcgtcgctcgcacgaccggtgctcgatttagagtgagctcgttgggttttgggggagaagagctgcgtcagttcacggacccagacgggaaccacttcggaaacccctagcgcagcttctcttcctcctgctactctggcctccccagaaaccaccggtaggagattgtgttggtaccgtctagtctcctaggcacccttgtctttgtctccgaggggacagacgtccaccctctccgtgggcggggcctaggtccaaagttcgttacccggcgtactacttacgcctggtaccagcagaacctggcagctccagactctnatcanagtnatcacaggccngggcntcccgagcaggttcagtggcagtggtctaggggacaggacttacacgtctcaccgattcgagtacgagacgtaggtacaccgtagaagtacttttagactaaatacgttaactttaacgttacgttacgtacgtactaaattaacttacgtacctaacccgtaaccccccgtaacgttacccgtaacccgtttaccgggacccgaaacggggaccctaaccggtaaccgttacggtaaccgtaacgtaagttaacggtaaaacggtaacggttacgggtacggtacgtcggtaccgtaacccgtaacgttccgttcggttcccgttaacccgg

SEQ ID NO: 174794 - DNA, 565 bp, Homo sapiens
  misc_feature: GYAE6OF01DEYS7.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccagctccagactctcatccacaatatattctacaggccgcggcatcccagactaggtcagtggacagtggtctgggacagacttcactctcacatcagcagactgagcctagaagtattttgactaattgtattacgtagtacagtactaatatgtcctacccaacccccgtactacctacccgttaccggaccgaacgggaccaccgaacttcgaccgaagacgtaacggaaaacgtaacgttggtacggaccgtacgtaccaaccgtacttctcgttccttaccg

SEQ ID NO: 174795 - DNA, 578 bp, Homo sapiens
  misc_feature: GYAE6OF01EYQCM.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaaacctggccaggctcccagacctcctcatccacaatatattctacgagggccgcgggcatcccagacaggttcagtcgcagtggtctgggacagacttcactctcacatcagcagacgtggacgccgtagaagtatttagactaagttagtattacgtgtacagtactaagttactcgtcctacccgtaccccccgactacctacccgttaccggacccgtaacgggaccaaccgactcggaccaaggtacgtaacgaaacgtaacgtcggtcggactacgaccacctattccttcgttccttacc

SEQ ID NO: 174796 - DNA, 512 bp, Homo sapiens
  misc_feature: GYAE6OF01A4AD7.21.33.C11.1.454.CMB.1.raw
  modified_base (496)..(496): a, c, t, g, unknown or other
  misc_feature (496)..(496): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcacatcagcagactggacgcctagaagtatttgactaattgtattactgtacagacaatatgctccacccccgatacctaccttcggaccaaggacacgactgacagagtagaacgactgacgntcgacacatctgtctc

SEQ ID NO: 174797 - DNA, 645 bp, Homo sapiens
  misc_feature: GYAE6OF01C6K4G.21.33.C11.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccaagaaaccaccggagagattgtgttgacgcagtctcaggcaccctgtcttgtctccgagggacagacgccacctctcctggcggggccagtacaaattcgtaccgcgtactacttagcctaggtaccagcaagaaacctggccaggctcccagacctccncactccaactaatatacttccacgacgggcccgacgggcactcccagactaggttcaggtgcgaggtggtacgtgggaacagtaccttcacgtcctacaccagtccaagcgaagacgtaggacgtaccgtagtaacgttagtttagactaagttagttaatttacgttgtacctaagtactaaattcgtaccgtacccttaccccgaaccccccgtagttacccctaacccggtttacccggaccggtaaacgggacccgtaacgtaccgttacggaacgtaacggaacgtaacgaaaaccggtacgtcggtacggactacggaccacgtattccttgtccttacc

SEQ ID NO: 174798 - DNA, 582 bp, Homo sapiens
  misc_feature: GYAE6OF01ADEZ3.21.33.C11.1.454.CMB.1.raw
  modified_base (400)..(400): a, c, t, g, unknown or other
  misc_feature (400)..(400): n is a, c, g, or t
  modified_base (464)..(464): a, c, t, g, unknown or other
  misc_feature (464)..(464): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctccagaaaccaccggagagattgtgttgacgcagtctccaggccaccctgtctttgctccgaggggacagacgccaccctctcctggccggggccagtctaaattcgtacccgcgactacgttacgccgtggaccagcaacgaaacctggccaggcctacccagacctccacactccaacaatactactctacgacggggcccgcgggcactcccgagacgaggttccaggtcggcaggtgggtctgggacagtactcactcncaccatcagccagacgtggacgcagtagtatttgactagtagtacttactagtcagtactaatntacgaccctcccgaaccccgtactacccgtaccgtaccggaaccgaacgggacctaacgtacgtcgaccagtaacgtacgaacgacgtgtacgctacgtccactatcgtcgttctccg

SEQ ID NO: 174799 - DNA, 615 bp, Homo sapiens
  misc_feature: GYAE6OF01D8XRC.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgcggggccagtcaaattgttacccgcgactacttagcctggtaccagcagaaacctggccaggctcccagactcctcatccacaatatattctacagggccgcgggcatcccagacaggttcagtggcagtggtctgggacagacttcactctacaccatccagacagactggagcctagaagtattttagactaagtagttattactgtacagacaaatactgtacctaccgaaccccccgtactaccgtaacccgtttaccgggacccgtaaacggggacctaaccggaacctacggtaccgaaacgaacgttaacggaaaaaccggtaaaccgttacggtacgggtaccttacggacccgtaaaccctactttccgttaggttcctttaacccg

SEQ ID NO: 174800 - DNA, 593 bp, Homo sapiens
  misc_feature: GYAE6OF01CXHMX.21.33.C11.1.454.CMB.1.raw
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggcctcccagaaaccaccggagagattgtgttgacgcagtctccaggcaccctgtctttgtctccgaggggacagacgccaccctctcctggcggggccagtctaaattcgtacccgcgactacttagcctggtaccagcagaaacctggccaggcctcccagacctcctcactccaacaatatattctacgagggccgcgggcactcccagacaggtcaggtggacaggtgggtctggggacagacttcacttcctcaaccatcagcagactaggacncctagaagtntttgactaagtgttattactgtacagactaatatcgcctacccaacccccgtataccctaccgttaccggaccgtaacgggacctaccgacgtacgaccagtaacgtacggaaaacgtacggttgtacgggtcctacggaccctaaccgtattcgtcgttcccttaccg

SEQ ID NO: 174801 - DNA, 543 bp, Homo sapiens
  misc_feature: GYAE6OF01EE12O.21.33.C11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctcgggtcccacgacgggccactggcacgtcccagacaggttcagtggctaggtcgggtctgggacaggtaccttcactctcatctattagcagacgtggacgtcctagaagtacgtttcgactaggttgtattacgtgtacagtcgtagtatggtaacttcaccttcgtgtccgttacggaccgaagggaaccaaggtacgaaagtagaaacgtactaggaggctgcgtaacg

SEQ ID NO: 174802 - DNA, 641 bp, Homo sapiens
  misc_feature: GYAE6OF01BLC9A.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctggcggggccagtcaaagttcgtacccgcgactacttagcctggtaccagcagaacctggaccaggcctcccagacctcctcactaccactaatatacttaccacgacgggcccgacggcactcccagactaggttcagtcggactaggtgggtcgtgggacagacttcactctacacatacgagcagacgtggacgtccgtagtaacgttagttttacgactaaagttacgttaacgtttacgtacggttacaacgtactaaacttagtaccgaccgttaccccgtaacccccgtagtaccctacccgttacggacccgtaaacgggacctaaccggtacgtacgacgtaaggtaacgtaacggaaacgtacgtcggtacgtacctacggacctaaccgtacttcgtcgttcttacccg

SEQ ID NO: 174803 - DNA, 570 bp, Homo sapiens
  misc_feature: GYAE6OF01BYXKE.21.33.C11.1.454.CMB.1.raw
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaacctggccaggctcccagacctcctcatccanaatatattctacaggggccgcgggcatcccagacaggttcagtgcagtgggtctgggacngacttcactctcacatcagcagactggacgcctagaagtatttgactaatgtattacgtgtacagactaattatacgcctacccacccccgtactacctacccgttccggaccgaacgggaccaaccggtacgtacgacgaagtaacgtacgaaacgtaacgtcggtacggtcgtacgacctaccgtattccgttgttcttaccg

SEQ ID NO: 174804 - DNA, 555 bp, Homo sapiens
  misc_feature: GYAE6OF01DHWH0.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgccggggccagtcaaattgttacccgcgactacttagcctggtaccagcagaaacctggccaggctcccagactcctcatccacaatatattctacgacgggccgcgggcatccccgagacaggttcagtggcaggtgggtctgggacagaccttcactctcaccatcagcagactaggacgacctgaaagtattttgactaaattgttaattactgtcaagtacaatatcgctaccaccccgatctaccgttcggaccgaaggccacgctacgacagtatacggaaacgtacgtggtacggctacgaccgactacgttacttgttcctttaccg

SEQ ID NO: 174805 - DNA, 568 bp, Homo sapiens
  misc_feature: GYAE6OF01CBQOJ.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcaagaaacctggccaggcctcccagacctcctcactcccaacaattatacttcctacgacggggccgcgggcactccccagactaggttcaggtgcaggtgggtctgggacagactcactctcacatcagcagactggacgcctagaagtatttgactaatgttacttactgtactagtactaatactcgacctacccacccccgtactcccgtacccgttaccggaccgaacgggacaccgacgtcgacaagacgtacgaaacgtacgtgtacgctacgaccaccatcgtgtcttacc

SEQ ID NO: 174806 - DNA, 526 bp, Homo sapiens
  misc_feature: GYAE6OF01D8J9N.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtgcagtgggtctgggacagacttcactctcaccatcagcagactggagcctgaagtattttgactaatgtattactgtcagacaataatgctccacccccgtactcctacccttcggacccgaagggaccacgactgacagactacgaaagaactgcggctacgcaacccattcctgtcttac

SEQ ID NO: 174807 - DNA, 675 bp, Homo sapiens
  misc_feature: GYAE6OF01C1SCE.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgtacccgcgactacttagcctggtaccagcagaaacctggaccaggctcccagactcctcactccacaatactattctacacgggccgcgggcactcccagacacggtcagtggctaggtgggtctaggggacaggtacttcgactctacaccatcaagcacgacgtggacgacctggtaaatagttttacgactaagttagttaactttacgtagttaccgaacgtactaaattaacgttaccggtaccttaacccctaacccccccgtaacgttacccgtaaccccggtttaccggtaacccggtaaacggggacccgtaacccggtaaccgttacggacccgaaggtacgtaaaacggtaaaaccggtaacgttacggtaccgggtaccgttacgaccgtaaacccctaggtttcctcggttacctttaacccg

SEQ ID NO: 174808 - DNA, 531 bp, Homo sapiens
  misc_feature: GYAE6OF01D7RSH.21.33.C11.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccncgggcatcccagacaggttcagtggcaggtggtctgggacagacttcactctcaccatcagcagactggagccgtgaagtatttgactaatagtattacttgtacagctaatatcgctcccacccccgatcctaccgttccggaccgaacggaccacgactgccagacgtacgaaacgaacgtcgtggctacgcactatctgtcttacc

SEQ ID NO: 174809 - DNA, 917 bp, Homo sapiens
  misc_feature: GYAE6OF01A2BQM.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccacggagagattgtgttgacgcagtctccaggccaccctgtctttgtctccgaggggacagacgcccaccctctccgtggcggggccagtacaaattcgttacccgcgtactactagcctggtaccagcaagaaacctggaccaggcctcccgagacctcctcactacccaactaatacttacttacctaacgacggggcccggacggggccaaccttccccgaaggtaaccgtacgggtttaccaagggttcgggaccgtaagggtttcggggggttaccgtagggggggtaaaccctaacggggttaacccttttaccgtaaaccccgtttcccgttaaccccgaaacccccgtaaagttaacccgtaaacgggaacccgtaaacggggaacccgtttacgggggtaaccgttaaccccgggttaggttaaaaacgggttttacggttttttaacggaaccttaaaggttttacggtttaaaccgttttaaccgtttacggtaacccgtaacggtaaacccttaaacgtttaacgttacccggttaacccgtaccccccggtaaaccccccccgtaacttaccccccgttaaccccggtttaacccgggaacccggtaaaccggggtaccctaaaccgggtaccgttacggaacccgtaacgggtaaacgtaaaccgggtaaaacccgttaacgggtccggttacgggtacccgttacggtaacccgtaaccgttaacgtttacccgttcgtttacccgttaaccccg

SEQ ID NO: 174810 - DNA, 777 bp, Homo sapiens
  misc_feature: GYAE6OF01D7CH2.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacaggagcccaccctctcctggccggggccagtcaaattcgtacccgcgactacttagcctggtaccagcagaaacctggccaggctccagactcctcactccacaatatacttctacgacgggcccgcgggcactcccagaccgtaggttaccaggtcggctaggtcggggtctaggggacacggtacttacacctacctaccgaaacctagttacccgaaacggtacctaaggtaacccggttacggggtaaccggtaccccgttaagggttaaaacggtttacggttttttacggaaccgttaaaagtttacggtttaacttttaacggtttacggttacgtaacggtaaccgttaaagttaacttaccggtacccttaaccccgtaaccccccgggtaacttaccccgttaaacccggttttacccgggaacccggtaaacgggggaccctaaccggtaaccgtacggtaccgtaacgggtaacgtaaacgggtaaaacccggtaaccggttcgggtacggtaccgtacgtacccgtaaccgtacgtttacccgttcgttccgtttaccg

SEQ ID NO: 174811 - DNA, 777 bp, Homo sapiens
  misc_feature: GYAE6OF01BLSCO.21.33.C11.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagagtgagctcgttgggtttgggggagaagagctgctcagtcaggacccagagggaaccatggaaacccagcgcagcttctcttcctcctgctactctggctccagaaaccaccggagagattgtgttgacgcagtctccaggcacctgtctttgtctccgaggggacagacgccacctctccgtgcgggccagtctaaattcgttacccgngtactacgttagcctggtaccagcaagaaacctggccaggcctacccgagacctcctacactccaactaaagttatactttacgaacgacgggcccgacgggactaacgtccccgaagtaccgtacgggttaccaaggtcggtacgtaaggttggggtaccgtagggaaccgtagtaccgttaccaacttccgtaccaaccgtacttaccgaacgtaccgaacggtacgttacgggaacgtacccggttaagtaaacggtttaacgtttttacggaaccgttaaagtttacggtttaacgtttaacccgttaggttacccgaacggttaacttaaacgtttaagttcccgggtaacccttaacccccgaacccccccgtttaagttaaccccgttaaccccggtttaccgggacccgtaaaaccggggaccttaaacccggacgttaccggactaacggtaacgtaacggtaaaccgtacgtacggttcgaacgtcgtaacccgtacgtacttcgttcgttcccgttaaccc

SEQ ID NO: 174812 - DNA, 726 bp, Homo sapiens
  misc_feature: GYAE6OF01DUNAQ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccgagccacctgtctttgtctccgagggacagacgccaccctctccgtggccggggcctagtacctaaatttcgtacccgacgtaccttacgttacgccgttaggtaacccagacaacggtaaaccgtcgggaccacgggaccctacccgaacgtacctccctacacctaccaacctaattacttactttaccgaacgacgggcccggacgggtaccacgtccccaaggaaccgtacggttacgaggttacggaccgtaagggtcggggtacgtaggggaactaacgtaccttacctaacgttcctaccaacctacgtcgaacgtacgaacgtacgtacggtacgtaccctaggtaagttaacgtttacgaacgtaagtttacgttaacgttacgtacgtacgtagacttaacgtatccgtacctacccgtacccccgatacccgtaccgttccggaaccgtaacggaccgactaacgtcgacgtaagtacgtaaccggaacacggttcgacggtccgtacgacccgtactaccgtttcgtgttccttaccg

SEQ ID NO: 174813 - DNA, 555 bp, Homo sapiens
  misc_feature: GYAE6OF01BK5T5.21.33.C11.1.454.CMB.1.raw
  modified_base (442)..(442): a, c, t, g, unknown or other
  misc_feature (442)..(442): n is a, c, g, or t
  modified_base (530)..(530): a, c, t, g, unknown or other
  misc_feature (530)..(530): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgtacccgcgactacttagcctggtaccagcagaaacctggccaggctcccagactcctcactccacaatatattctacgagggccgcgggcactcccagacaggttcagtggcagtgggtctgggacagacttcactctcacatcagcagacgtggacgtcctagtaagtattttagactaatgttattactgtacagctaatntcgactacccacccccgactaccgtaccgttccggaccgaacggaccaccgactcgactagacgtacgaaacgtaactggtacggacncggaccacctattctgtccttaccg

SEQ ID NO: 174814 - DNA, 637 bp, Homo sapiens
  misc_feature: GYAE6OF01C1NEK.21.33.C11.1.454.CMB.1.raw
  modified_base (319)..(319): a, c, t, g, unknown or other
  misc_feature (319)..(319): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagagcccaccctctcctgcgggccagtcaaattgtacccgcgactacttagcctggtaccagcaagaaacctggccaggcctcccagactcctcatccacaatatattcacgngggccgcggcactcccagactacggttcaggtggctaggtggtctgggacagtacttcactcncactatcacgcacgacgtggacgccgtagtaagtatttagactaatagtattactcgtacagactaatactacgtaccctaccccaacccccgtacttaccctaacccgttaccggaacccgtaaacgggtaccgaaccggtaccgtacggaccgtaaacgtaaacgtaaccggaaaacggtaaccggttacgggttaccggtaccgttaaccgaccctaacccgtacgtttaccttcggttaccctttacccgg

SEQ ID NO: 174815 - DNA, 620 bp, Homo sapiens
  misc_feature: GYAE6OF01BAM9R.21.33.C11.1.454.CMB.1.raw
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctcctccgtggccgggggccagtcaaattcgttacccgcgtactacttagcctggtaccagcaacgaaacctggccaggcctcccagacctcctcactccaanaatatacttacacgacggccgcggcactcccagacctaggttcaggtgacgaggtgggtctagggactaggtacttcgactctcaaccntacagcagtacgtggacgtctagaagttattttacgactaagttagttaatttacgtacgtactaacgtactaaattacgtacgtaccctacccgaacccccgtacttacccgtacccgttaaccggaccgtaacgggaccaaccggtactacgacgaacggactaacggaaacgtacgtcgtacggactacgaccactatctgtcctacc

SEQ ID NO: 174816 - DNA, 541 bp, Homo sapiens
  misc_feature: GYAE6OF01CPUAC.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtaccgcgactacttagcctggtaccagcagaaacctggccaggctccagactctcatccacaatatattcacaggccgcggcatcccagacaggttcagtgcagtggtctgggacagacttcactctcacatcagcagactggagcctagaagtatttgactaatgtattactgtcagctaatatcgctaccacccccgtataccctaccgttccggaccaacgggtaccacgactacgcaagaacgtagaaaccgtaacgtggtacggtactacggacccaacgtatcttcgttcttacccg

SEQ ID NO: 174817 - DNA, 674 bp, Homo sapiens
  misc_feature: GYAE6OF01DORQJ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgccaccctctcctggcggggccagtcaaattcgtacccgcgactacttagcctaggtaccagacaacgaaacctggaccaggcctcccagacctcctcatccaacaatatattctacagggcccgcggcactccccgagacgtaggttcaggtggcgtaggtgggtctaggggactagacttcgacttctaccaaccgtatcgagcaagtacgtagggacgtcccgtaggtaagttagtttttacgacgtaaagtttacgttaactttaacgttggtacctaaggtaccttaaagttaacttccggaccccttacccccgaaccccccgtacttaccccgtaaccccgtttacccggaacccgggtaacggacccgaacgtacgtacgacgaagtacgtaacggaaacgtacggtcggtacgtacgtaccgtaacctactaacgttccgtacgttccttacccg

SEQ ID NO: 174818 - DNA, 566 bp, Homo sapiens
  misc_feature: GYAE6OF01CGZCD.21.33.C11.1.454.CMB.1.raw
  modified_base (253)..(253): a, c, t, g, unknown or other
  misc_feature (253)..(253): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctccgtggccggggccagtcaaattcgttacccgngactacttacgcctggtaccagcagaaacctggccaggctcccagactcctcatccacaatatattctacaggccgcgggcactcccagacagttcagtggcaggtggtcgtgggacaggacttcgactctcacatcagcagactggagccgtagaagtattttgactaatgttaattacgtatacagactaactatgtacctaccgacccccgtactaccctaccgttccggaccaacgggacaaccgactagacctaggaactacggaaacacgtaggtcgtacacgtacaacctatcgtcgttcgttacc

SEQ ID NO: 174819 - DNA, 561 bp, Homo sapiens
  misc_feature: GYAE6OF01EUIIA.21.33.C11.1.454.CMB.1.raw
  modified_base (379)..(379): a, c, t, g, unknown or other
  misc_feature (379)..(379): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacaggggcccgcggggcactccccagacaggttcagtggcagtgggtctgggacagacttcactcncaccatcagcagactggacgcctagaagtattttagactaatacgttatttacgtgttcagactaatactgctaccaccccccggtatacctacccttccggaccgaacgggaccaacgacgtacgacagaagtacggaaacgaacgtcggtacggactacgaccacattcctgtcttaccg

SEQ ID NO: 174820 - DNA, 562 bp, Homo sapiens
  misc_feature: GYAE6OF01CD8XF.21.33.C11.1.454.CMB.1.raw
  modified_base (251)..(251): a, c, t, g, unknown or other
  misc_feature (251)..(251): n is a, c, g, or t
  modified_base (386)..(386): a, c, t, g, unknown or other
  misc_feature (386)..(386): n is a, c, g, or t
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctgccggggccagtcaaattcgttacccgngactacttagcctggtaccagcagaaacctggccaggctcccagactcctcatccaacaatatattctacagggccgcgggcactcccagacaggttcagtggctagtgggtctggggacagcttcactctcacntcagcagactggagcctagaagtatttagactaaattgtattacgtgtacagactaatatcgactacccaacccccgtatcctaaccgttccggacctaacgggaccaacgccgttagaccaaggactacggaaagtactggacgtctcggtaccaaccgattcctgtccttaccg

SEQ ID NO: 174821 - DNA, 867 bp, Homo sapiens
  misc_feature: GYAE6OF01E3U2J.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgtgacgcagtctccgaggccacctgtctttgtctccgaggggacagacgcccaccctctccgtggccggggccagtacaaattcgtacccgcgtactactacgcctaggtaccagcaacgaacctggcccaggcctacccagacctcctacgactaccaacaattactacttaccgtaacgacggggtcccggaccgggacctaacgttcccccgaagtaaccgtacgggtttacgaacgggttcgggaccgtagggttcgggggttaccggttaagggggaaccctaacggttacccgtttaccgtaaccgttccctacccaacccgtaacgttcccgaaacgggacccgtaacgggtacggttaccggggaaccggtaccgtttaagggtaaacggtttacgtttttacgaacttaaaggttttcggtttaacgtttaaccgttcggttaaaccgtaagtaaccgtaaagtttaaccgtcccggtaaccccgtttacccccgaaccccccgtaccgttaccccggttaaaccccggtttacccgggaaaccccggtaaaaccgggtacccgtaaccggtaaccgtcggtaaacccgaaaggttaaaccggtaaaccggtaaaaccggtacccggttagggtcccggtaaccgttacccgaacctaacccgttaactttccgtttaccggttacccgttaacccg

SEQ ID NO: 174822 - DNA, 532 bp, Homo sapiens
  misc_feature: GYAE6OF01EOASQ.21.33.C11.1.454.CMB.1.raw
tcagtcgtcgctcgcacgaccggtgctcgatttagagtgagctcgttgggtttggggggagaagagctgctcagtcaggacccagagggaaccgtggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaaacctggccaggctcccagactcctcactccacaatatattctacagggccgcgggcatcccagacaggttcagtggcagtggtctggggacagacttcactctcaccatcagcagactggagcctgaagtattttgactaatgtaattactgtacagactaatatcgctaccacccccgatccaccgttcggaccaaggacacgactgacagatagaaacgagtgtcggctgacctaccaacttctcgttctctacccg

SEQ ID NO: 174823 - DNA, 516 bp, Homo sapiens
  misc_feature: GYAE6OF01DGEP6.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtattttgactaatgtattactgtcagctaatatgctccacccccgatcctaccgttcggccgaacgggacacgactcgcagacgtagaaacgactgtcgctcgcacatctgtcttc

SEQ ID NO: 174824 - DNA, 579 bp, Homo sapiens
  misc_feature: GYAE6OF01AEAPA.21.33.C11.1.454.CMB.1.raw
  modified_base (480)..(480): a, c, t, g, unknown or other
  misc_feature (480)..(480): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctggccggggccagtcaaattgtacccgcgactacttagcctggtaccagcagaaacctggccaggctcccagacctcctcatccacaatatacttctacaggggcccgcgggcactccccagacaggttcaggtggcaggtcgggtctgggacagtacttcactctcaccgatcagcagacgtggacgtccgtagaagtatttagactaattagttattactgtactagtactaatactcgacctacccaacccccgtntacctacccgttccggacccgaacgggtaccacgtaccgcgacagtacgtaacggaaacgtacgtggtacgtcgtacgaccacattctgttccttaccg

SEQ ID NO: 174825 - DNA, 585 bp, Homo sapiens
  misc_feature: GYAE6OF01DCBIB.21.33.C11.1.454.CMB.1.raw
  modified_base (376)..(376): a, c, t, g, unknown or other
  misc_feature (376)..(376): n is a, c, g, or t
  modified_base (450)..(450): a, c, t, g, unknown or other
  misc_feature (450)..(450): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccacgaaaccaccggagagattgtgttgacgcagtctccaggcaccctgtcttgtctccagggacagagccacctctcctgcggggccagtcaaattcgttacccgcgactacttagcctggtaccagcagaaacctggccaggcctccacgactcctcatccacaatatattctacagggccgcgggcatcccagacaggtcagtggcagtgggtcgtgggacaggacttcgactcncacctatcagtcaacgactcgggagcctagaagtattttgactaagtgttattactgtacacgactaatagtcnccttacccgacccctacctccgtaaccctttaccgggaccaacgggtacgaccgtactcgaccgtagaagtaacggaaaacgtaaccgtgtaacgggcgtacgtaccgacccttagtcctcggttcctttacccg

SEQ ID NO: 174826 - DNA, 702 bp, Homo sapiens
  misc_feature: GYAE6OF01ESWO1.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctggcggggccagtcaaattcgtacccgcgactactagcctggtaccagcaagaaacctggccaggcctcccagacctcctcactccaacaatatacttctacgacgggcccgcgggacactcccgagactaggttcaggtggcgtaggtcgggtcgtgggaacagtaccttacgacctctaccaccatccgagccaagacgtggacgtccgtagtaaacggttattttacgactaaagttagttaactttacgttgtacctaagtactaaacttacgtacgtacccgtaccccgaaccccccgtaacttaccccgtaacccgtttaccgggaacccgtaaaccggggtaaccaacccggtaaccgtacggaccgtaaaggtaacgttaaaccgggaaaaccggttaacggttacgggtaacccggtaccgttacggaccctaaacccgttacgttaccgtttcggttcccctttaacccg

SEQ ID NO: 174827 - DNA, 585 bp, Homo sapiens
  misc_feature: GYAE6OF01DR76U.21.33.C11.1.454.CMB.1.raw
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccatcagaaacctggccaggcctcccagactcctacactaccacaatatattcctacacgggccgcgggcactcccagacagtcagtggactaggtggtcgtagggacngacttcacttcnccaccatccagcagactggagccgtagaagtattttggactaatgttaattacgtagtacacgactaatactcgtacctacccgacccccgtactaccctaccgtttaccggaccgtaaacgggaccaaccggtacgttacgacgagaactacggaaaacgtacgtaggtcggtacgtacgaccactagtctgtcttacc

SEQ ID NO: 174828 - DNA, 683 bp, Homo sapiens
  misc_feature: GYAE6OF01CDU6P.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctccgtggcggggccagtcaaattcgttacccgcgtactacttagcctggtaccagcagaacctggccaggcctcccagacctcctcactaccaacaattactacttccacgacggggccgcgggcactccccgagactacggttcacggtggcgtaggtcgggtctagggacacggtacttccactcctcaacctatccgaacgcagaccgtgggacgtaccgtagtaagttagttttacgaactaagttacgttaactttaccgttagtaccgtaagtactaaacgttactaccggtacctacccccgtaacccccgtacttacccgtacccgttacccgggaaccgtaaaccggggacctaaccggtacgtaccggacctaacggtaacgtaaccggtaaacgtacgttggtaccggtaccgtacgacctaacccgtacgttaccgttcgtaccctttaccg

SEQ ID NO: 174829 - DNA, 625 bp, Homo sapiens
  misc_feature: GYAE6OF01CYG2Y.21.33.C11.1.454.CMB.1.raw
  modified_base (572)..(572): a, c, t, g, unknown or other
  misc_feature (572)..(572): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctcaggcaccctgtctttgtctccgaggggacagacgcccaccctctccgtggcggggccagtactaaattcgtacccgcgtacttacttagcctggtaccagcacgaacctggcccaggcctacccagtacctcctcactccaactaatacttattacctacgacgggcccgcggcactaccccgagacgtaggttcaggtggctaggttcgggtcgtacggggaactacggtacttcaccttccaccaccgtatacgaacgcagtacgtgggacgtaccgttaggaagttacgttttacgactaagttgttactttacgtacgttacgagtactaatacgtccgacctacccgaccccgtactccgtaccgtacggaccgtaacgggactacgtacncgtacagtacgaacgaacgtacgtggtacgctacgacctactatctgtcttcg

SEQ ID NO: 174830 - DNA, 642 bp, Homo sapiens
  misc_feature: GYAE6OF01AL9AA.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgccggggccagtcaaattcgtacccgcgactacttagcctggtaccagcagaacctggccaggctcccagacctcctcactccacaatatactctacgacgggccgcggcactcccgagactaggttcaggtcggactaggtgggtcgtgggacagtaccttcactctacacctatcacgcagacgtcggacgtccgtagaagtacgtttagactaagttagttaactttacttagtacacgtactaagttactaccgtacccgttacccaaccccccgtatacccgtacccgttccggaacccgtaacgggaccctaacgtaccgtcgtaccgaacgtacgttaaaccggaaaccgtaacggttacggtaccgggtacctaccgacccgtacctaacgttccgttcgttcccgttacccg

SEQ ID NO: 174831 - DNA, 653 bp, Homo sapiens
  misc_feature: GYAE6OF01DAJTL.21.33.C11.1.454.CMB.1.raw
  modified_base (426)..(426): a, c, t, g, unknown or other
  misc_feature (426)..(426): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgccaccctctccgtgcggggccagtcaaattcgtacccgcgactacttagcctggtaccagacacgaaacctggaccaaggcctacccgaagtacctcctcactaccaacaatatacttacacgacgggccgcggcactccccgaagacacggttacaggtgcgaggttggcgtagggacagtacttcactcgtacacatcagacagacgtggacnccgtagaagttatttcgactaaattcgtaattacgtgtacagtacaatatacgccttaccccgaacccccgtacttacccgtaacccgttaccgggaaccgtaaacgggacccaacggtaaccgtacgacccgtaaaggaaccgttaaacggaaaacccgttactacgggtaccggaccgttacgacccgtaacctacgtttaccgtttccggttccctttaacccg

SEQ ID NO: 174832 - DNA, 799 bp, Homo sapiens
  misc_feature: GYAE6OF01DITIS.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaagaaaccaccggagagattgtgttgacgcagtctccaggcacctgtctttgtctcgaggggacagacgcccacctctccgtggcgggccagtacaaattcgtacccgcgtactacttacgccgtggtaccagacaacgaaccgtcggaccacggcctacccagtacctcctacactacccaataatacttacttcgacgacgggccgcggacactccgagacgtagtacaggtcgcgtaggtcgggtacgtacgggactacgtaccttcgaacttctaccaacctagtaccgaacgaccaacggtaccgttacgggaacgtacccgttaaggtaaacgtttaacgtttttacggaacgttaaagttacggtttaactttaacggttacgttaacgtaacgtaaccttaaagttaccgttaccgtaccccgtaaccccccgtaacccccggttaacttacccccgttaaacccggtttacccgggaaaccccggtaaaccgggacccgtaaaccggtaacccgttacggaaaccgtaaaccgggtaaacgttaaaccgggtaaaaacccggtaacggttcggggttaaccggtcccgttaaccgtaacccgttaaacccgttaccgtttccgtttaaccggttccccgtttaaacccg

SEQ ID NO: 174833 - DNA, 637 bp, Homo sapiens
  misc_feature: GYAE6OF01DGX6Y.21.33.C11.1.454.CMB.1.raw
  modified_base (401)..(401): a, c, t, g, unknown or other
  misc_feature (401)..(401): n is a, c, g, or t
  modified_base (427)..(428): a, c, t, g, unknown or other
  misc_feature (427)..(428): n is a, c, g, or t
  modified_base (445)..(445): a, c, t, g, unknown or other
  misc_feature (445)..(445): n is a, c, g, or t
tcagtcgtcgctcgcacgaccggtgctcgatttagagtgagctcgttgggtttggggggagaagagctgctcagtcaggacccagagggaaccatcggaaaccccagcgcagcttctcttcctcctgctactctggcctccagaaaccacggagagattgtgtgacgcagtctccaggcaccctgttcttgtctccgaggggacagacgcccacccttctccgtggcggggccaggtctaaattcgtacccgcgacttactacgccgtaggtaccagacaacgaacctggaccacggtcctacccgacgtacctcctctactccaactaatactactttcaccgagggcccgcgggactacgtacccgagacgtaggttcgagtcggcgaggtcggtacgngggacagtaccttcgctcgtaccacnncgagcacgtgcggtacncgtagaagttattagactaattgtacttagtcgtacagacttaatctccgaacctcccgaaccccgtctacctaacccggtaccggtacgaacggtaccacgtactcggaaccgtagaaacgtaccggtaaacgtacggttcggtaaacgccgtttaacaccctaccgtattcccgttgttcctttaacccg

SEQ ID NO: 174834 - DNA, 628 bp, Homo sapiens
  misc_feature: GYAE6OF01AOEAY.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctggcggggccagtcaattgtacccgcgactacttagccttggtaccagcaagaaacctggccaggctcccagacctcctcactaccacaatactattctacgacgggccgcgggcactccccagacaggttcagtggcaggtcgggtctgggactagtacttcactctaccactagtcagacaagacgtggacgtccgtagtaagttagttttcgactaattagtatttactcgtacagtacaattatacgtacctacccgtaacccccgacttacccgtacccgttaccggaccgtaacggaccgtaccgactacggactaacggtacgtaaccggaaaccgtaaacggttcggtaccggaccgttcggaaccctaacccgtacgtaccttcggttccgtttacccg

SEQ ID NO: 174835 - DNA, 572 bp, Homo sapiens
  misc_feature: GYAE6OF01EDQCM.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactactagcctggtaccagcagaaacctggccaggctcccagactcctcatccaacaatatacttctacgagggccgcgggcactcccagacaggttcagtggcaggtgggtctgggacagacttcactctcacctatcagcagactggacgcgtagtaagtatttacgactaagttagtactttacgtgtacgtagactaattatcgtcctaccctaacccccgactacctaccgttaccggaccgaacgggaccaccgtactcggacaagaagtacgaaacgtacgtcggtcggctacggaccacgtattctcgttcctaccg

SEQ ID NO: 174836 - DNA, 619 bp, Homo sapiens
  misc_feature: GYAE6OF01CYG9Q.21.33.C11.1.454.CMB.1.raw
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctgccggggccagtcaaattcgtacccgcgtactacttagcctggtaccagcagaaacctggccaggcctacccagacctcctacactcccaactaatacttattacctacgacggggcccgcgggcactacccagactaggtcaggtcggcaggtgggtctgggacagtacttcactctcaccatcacgacagacgtggacgtacctagaaagtattttagactaattgttaacttacgtgtacagactaaatatacgtcctaaccccgacccccgtattacccgtacccgttaccggaacccgtaacgggaccaaccgtacgtcgacagtacgtaacgaaaccgtagttacggtacggtacgtacgaccgaacctattacgttcgttccttacg

SEQ ID NO: 174837 - DNA, 646 bp, Homo sapiens
  misc_feature: GYAE6OF01ENLEK.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctcctccgtcggcggggccagtcaaagtttcgttaccccgcgacttacttacgcctaggtaccagcaacgaaacctggccaggcctacccagacctcctcactcccaactaatattactttaccgtacgacggggcccgcgggaccactaccccgaagacgtaggttcaggtcggacgtaggtcggggtcgtaggggaacacgtacttcgaccttctaccaaccctagtcaacgacgaacgtacgtaggtacgtaccgtagtaacgtattttacgactaagttgttaacttacttcgtacacgtactaatatcgtacctacccacccccgtactacccgtaccgttacggaccgtaacggaccaacgtactagaccaagtacgtaacgaaactaacgtggtcgactacgcctaacacgttcttgtcttaccg

SEQ ID NO: 174838 - DNA, 593 bp, Homo sapiens
  misc_feature: GYAE6OF01BUV66.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgcggggccagtcaaattcgtacccgcgactacttagcctggtaccagcaacgaaacctggccaggcctcccagacctcctcactccaacaatatattctacgagggccgcgggcactcccagacaggttcagtggcagtgggtctgggacagcttcactctacaccatcagcaagctggacgctagaacgtatttagacaagttcgtaattacttgtactaagactaatactcgtccctaccctaccccccgtacttacccgtacccgtttaccggacccgaacgggaccaaccgtcgtacgccgaagacgtaacggaaacgtacgttcggacggtctacggaccaacctagttaccttcgttaccttaccg

SEQ ID NO: 174839 - DNA, 608 bp, Homo sapiens
  misc_feature: GYAE6OF01DI3TO.21.33.C11.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgccggggccagtacaaattcgttacccgcgactacttagcctggtaccagacagaaacctggccaggcctacccagactccncactccacaatatattctacgacgggccgcgggcactcccagactaggttcaggtggctaggtgggtcgtgggacagtacttcgacttcgtcaccatcagcagacgtggacaccgtagaagtattttgactaattgttaattactgtcaagactaatactcgtacctaccccgtacccccgtacttacccgtacccgttccggaacccgtaacgggacaaccgtaccgtacgccgtaagtacgtaacggaaacgtaacgtcggttacggcgttaccgacctaacctattccgtgttccttacccg

SEQ ID NO: 174840 - DNA, 601 bp, Homo sapiens
  misc_feature: GYAE6OF01ESWAJ.21.33.C11.1.454.CMB.1.raw
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
tcagtcgtcgctcgcacgaccggtgctcgatttagagtgagctcgttgggtttgggggggagaagagctgctcagtcaggacccagagggaaccatggaaacccaacgcgcagcttctcttcctcctgctactctggctcccacgaaaccaccggagagattgtgttgacgcagtctccaggcaccctgtctttgtctccaggggacagacgccaccctcctcctggccggggccagtactaaattcgttaccccgcgacttacttacgcctcggtaccagcaacgaaacctggccaggcctcccagactcctcactccaacaatatattctacgacgggccggcggcactacccagtacgacggttcaggtcggcaggtgggtctgggaacagtacttcactctcacctancagcagactggancctagaatagtttgactaatgtattacgtagtcagtacaatactcgccctcccaacccccgtcttacctaccccgttacggacccgaagggaccaacgtaccgtagacgaacgtaacgtaacggaaaaccgtacgtggacggtcgtacgacctaacctattcgtcgttcttaaccg

SEQ ID NO: 174841 - DNA, 601 bp, Homo sapiens
  misc_feature: GYAE6OF01E0UPE.21.33.C11.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagagtgagctcgttgggtttggggggagaagagctgctcagtcaggacccagagggaaccgtggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccaacaatatatacagacgcggcggcgcacacacgtacgtacgtacgtacgngtcgtgtcggtcgtacggacgtacgtactactactactactacactacgacgacgacgacgtacgtacgtacgtacgtagtagttacgtataattacgttagttacgtacgtacgtactactactacgtaccgtacccgtacccgtaccccgtaccgtaccgtaccgtaccggtaaccgaccgacgtacgacgtacgacgaacgtacgtaagaacgtacgtacgtacgacgtacgacactctcgtcgtac

SEQ ID NO: 174842 - DNA, 618 bp, Homo sapiens
  misc_feature: GYAE6OF01CYDTH.21.33.C11.1.454.CMB.1.raw
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggcctcccagaaaccaccggagagattgtgttgacgcagtctccaggcaccctgtctttgtctccgaggggacagacgcccaccctctcctggccggggccagtacaattcgtacccgcgactacttagcctggtaccagcacgaaacctggccaggcctcccagacctcctcactccacaatactatcctacacgggcccgcgggcactccccaagacacggttcaggtggcaggtgggtctggggacaggtaccttcgactctcaccatcagcagactgggacgtcctaggaagtattttagactaagtgttacttatcgtacgagtactaaatctacgacctaccccgacccccgtactacccgtacccgttccggaaccgaacgggacctaaccgaccgtcgacgagtaacgtacgaaacgtaccggtggtaccggtactaccggtacctaaccgtatttccgtcgttccgttaacccg

SEQ ID NO: 174843 - DNA, 844 bp, Homo sapiens
  misc_feature: GYAE6OF01EBFN3.21.33.C11.1.454.CMB.1.raw
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctccgtggccggggccagtacaattcgtacccgcgactacttagccgtgtaccagacagaaacctggaccaggcctcccagacctcctcactaccaactaatactacttccgtaacgacggggtcccggcgggccacttaccccgaagtaccgtagggtttacagggtcggacgtagggttggggtaccgtagggggaacctacgggtacctttaccgaaccgttacctacccgaaacccgtagttacccgaaacggtccgtaaaggtacccgtaggggaccgtacccggttaaggtaaacggtttaacgtttttacggaaccgttaaagtttacggtttaacttttaaccggttacggttaacgtaacggttaacctaaacgtttaaccgttccggttaaccccgtaccccccgtaaacccccccccggttaacgttacccccggttaacccggttaacccccggggtaaaccccgtaaaccggggtaacccgtaacccggtaaccgttaccgaaccggtaaacggtaaccgttaaacggaaacccgttaaaccggttcgggtaccggtacggtacccggtaccctacccgttacttaccggtttaccgttacctttaccccg

SEQ ID NO: 174844 - DNA, 655 bp, Homo sapiens
  misc_feature: GYAE6OF01BMORV.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccagaaaccaccggagagattgtgttgacgcagtctccaggcaccctgttctttgtcctcgaggggacagacgcccaccctctccgtggccgggccagtctaaagttcggttacccgcgtactacttacgccgttggtaccagcaacgaaaccgtggccaggcctacccgagacctcctcactaccgactaattatacttcctacgacgggccgacggcacgtcccagtactggttcagtcggctaggtgggtacgtgggacagtacgttacaccgtctacgacctatcgagacacgtacgtggacgtacctagtaagttagtttcgacgtaagttagttattacgtagactacggactaagttacttcgtaccctacccgaaccccccgtatacccgttaccgttaccggaaccgtaacgggtaaccgaccgtaccgtacgactaacggacgtaacggaaaccgtacgtacggcgtacacggtacctaaccttacgttcgtcgtttccgttaccg

SEQ ID NO: 174845 - DNA, 547 bp, Homo sapiens
  misc_feature: GYAE6OF01B8EEW.21.33.C11.1.454.CMB.1.raw
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctggccggggccagtcaaattcgtacccgcgactacttagcctggtaccagcagaaacctggccaggctcccagactcctcatccacaatatattctacagggccgcgggcactcccagactaggtcagtggcaggtgggtctgggacagacttcactcncacatcagcagacgtggactcctaggaagtntttacgactaattagtattactagtcaagacaatatcgcctcccaaccccctatcctaccgtccggaccgaaggacacgactcgacagacgtacgaaacgtacgtgtcggctacgaccacatctgttcttaccg

SEQ ID NO: 174846 - DNA, 600 bp, Homo sapiens
  misc_feature: GYAE6OF01EEL0D.21.33.C11.1.454.CMB.1.raw
  modified_base (532)..(532): a, c, t, g, unknown or other
  misc_feature (532)..(532): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagcccaccctctcctggccggggccagtcaaattcgtacccgcgactacttagcctggtaccagcaagaaacctggccaggcctcccagacctcctcatcccaactaatatacttctacgacggggccgcgggcagtcccagacaggttcagtggcaggtgggtcgtgggacagtacttcactctacacctatcagcagacgtggacgcgtagaagtatttcgactaagttgttaacttacgtgtactagtactaattacgtacgtacctacccaaccccccgtataccctaccgttaccggaccgaacggaccaaccgtacgngaccgaagtacgtaacggaaaccgagtcggtacggctacggtacctaactacttcgttgtccttaccg

SEQ ID NO: 174847 - DNA, 722 bp, Homo sapiens
  misc_feature: GYAE6OF01B3V3M.21.33.C11.1.454.CMB.1.raw
  modified_base (366)..(366): a, c, t, g, unknown or other
  misc_feature (366)..(366): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctccgtggccggggccagtactaaattcgtacccgcgactacttagcctggtaccagcaagaacctgaccaggcctcccagactcctcactccacaatactattcgacgacggccgccgggtacacccgagacgaggttaccagtcggngaggtcgggtacgttcggggaacctacggtacctttccaccgtacccttaccgaacctacgtaccgaacgtccgtaacgaccggttacgggacgtaccccgttaagggtaaacgtttaagtttcgtaaccgtaagtttacggtttaacttaacttcggtaactacgggaacttaagttaacgcgttaccctcccgaaccccccgtattacccgtaccccgttacgggaacccgtaaaccgggacccgaactaaccggttacgaacgtacggaaacggtaacgaaaacggttaaccgtcggttacgtacgtaccgaaccctaacctacgtttacctcggtcctttaaccggtacccc

SEQ ID NO: 174848 - DNA, 788 bp, Homo sapiens
  misc_feature: GYAE6OF01DJIU0.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaagaaaccacggagagattgtgttgacgcagtctccgaggcacctgtcttgtctcgaggggacagacgccaccctctccgtggccggggccagtactaaacgttcgttacccgcgtaaccttacgttacgccgtaggtaccagtaccaacgtaaaccgtcggaccgaacggtcctacccacgtacctcctacactaccgaactaattacttattaccgtaacgacggggcccggacgggaccacgtaccccaagacgtacgttacgacggtcggacgtacgggttcggtacgtaggggaactacgttaaccttcgaccttacctacccgaacctaacgtccgtaaacggcgtaaacggaccgttacgggaaccgtaaccgttaaggtaaacggtttacgttttaacggaaccgtttaaagttaccgttttaacgtttacgtacgttaaacgaacgttactaaagttaccgttacgtaccccgtaaccccaacccccggttactaccccgttaacccgtcccgggtaaccgtaacggacctaccggtaaccgtcgacgtaacgtaacgtaaaccggaaaccggttacgtacgggtaccggtcgtaaccgtaacccgtaaccgtacttccgttacgtttcccgtaaccg

SEQ ID NO: 174849 - DNA, 744 bp, Homo sapiens
  misc_feature: GYAE6OF01B9F3D.21.33.C11.1.454.CMB.1.raw
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctggccggggccagtcaaattcgttacccgcgactactagcctggtaccagcaacgaaacctggaccaggcctacccagacctcctacactaccaacaattatacttcaacgacggggcccgcgggacactcccgagactaggttcaggtcggactaggtcgggtacttcggggaactacggtaccttaccgaaccttcccgtaaccaacccgtataccgaaacggccaacggtaacgtcgggtaacggtacccgttaaggtaacggttaacgtttttagaacctaaagtttacgtttaatttaacgtacggttaccaagtactaaacttacgttaccgtacccttaaccccgaaccccccgttactaccccgttaacccggttacccggaacccgaaacggggtaccctaaccggaccgttacggaccgtaaacggtaacgtaaacgggaaaccgtaacggttcgggtacggtaccgtaccgtaccgaacccttaagttcccggttcgttccttaacccg

SEQ ID NO: 174850 - DNA, 574 bp, Homo sapiens
  misc_feature: GYAE6OF01BAVYI.21.33.C11.1.454.CMB.1.raw
  modified_base (371)..(371): a, c, t, g, unknown or other
  misc_feature (371)..(371): n is a, c, g, or t
tcagtcgtcgctcgcacgaccggtgctcgatttagagtgagctcgttgggtttgggggagaagagctgctcagtcagggacccagagggaaccatggaaaccccagcgcagcttctcttcctcctgctactctggactcccagaaaccaccggagagattgtgttgacgcagtctccgaggcaccctgtctttgtctccaggggacagagcccaccctctcctgccggggccagtcaaattcgttacccgcgactacttagcctggtaccagcagaaacctggccaggcctcccagacctcctcatccacaatatattctacgagggcccgcgggcatcccagacaggttcagtggcagtggtctgggacngacttcactctcacctatcagcagacgtggacgcctagaagtatttagactaattgtattacgtgtacagactaatctcgtccttacccgacccccgtatcccgtacccgttccggacccgtaacgggacctacggacctcgaccgaagtacgtacgaaacgtacgtggtacgccgttcgaccacctatcctgttccttaccg

SEQ ID NO: 174851 - DNA, 715 bp, Homo sapiens
  misc_feature: GYAE6OF01CBIO6.21.33.C11.1.454.CMB.1.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
tcagtcgtcgctcgcacgaccggtgctcgatttagagtgagctcgttgggtttggggggagaagagctgctcagtcaggacccagagggaaccatcggaaaccccagcgcagcttctcttcctcctgctactctggctcccaagaaaccaccggagagattgtgttgacgcagtctccaggccacctgtcttgtcctcgagggacagacgccacctctccgtggcgggccagtcaaagttcgtacccgngactactacgcgtgtaccngacagaacctggaccaggcctacccgagtacctcctacaactacccaataactacttacttccgaaccggacgggccggacgggcaacgtcccaaggtacagggttcaggttggacgtacggttgggactaggggaactacggtcttactacctcgtacctaacctagtacccgaaggtccaacgtaccgtacgggtacgaacccgttaggtaaacgttagttttaaccggacgttaaagtttggttaaccttttaaccgtggtaaaccgttaactaacggttaaaactcgttaccgtacccgttacccccgaacccccggtacttaccccgttaaccgtacccgggtaccgaaaccgggtacaccggtacgtcgaaccgtaagtacggtaaccgaaaccgtacgtggtacgtacgacgtaccaactacgttcttcgtacttacccg

SEQ ID NO: 174852 - DNA, 747 bp, Homo sapiens
  misc_feature: GYAE6OF01DNFLM.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaccaccggagagattgtgtgacgcagtctcaggcaccctgtcttgtctcgagggacagacgcccaccctctcgtggtcggggccagtcaaattcgtaccgcgtacctacttagcctggtaccagacaacgaaaccgtcggacccaggtcctacccgaacgacctccctacaactaccccaactaattaacttactttaccgtaacggacggggtcccggacggggaccacttaccccgaacgtaaccgtacggtttaccgaagggtcgggacctaagggttcggggtccgtagggggaacctaggtaccttaccgaaccttccctaacccgtacctatacaacggtaccaacgggtacgtacggaccgtaccgtaagtaaagttacgttttacggactaagtttagttacttacgttcgtacagtacctaaattctaccgtacctaaccccgacccccgttacacccgttaaccccgtacgggtaacccgaacgggaccgaaccggtacgtaccgtaaccgaaggtaacggtaacgtaaaaccgtacggttacggtaccgggacttaccgtacctacctacgttaccgttcgttccgttaccc

SEQ ID NO: 174853 - DNA, 612 bp, Homo sapiens
  misc_feature: GYAE6OF01BT2ZZ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcacctgtctttgtctccaggggacagagccaccctctcctgcggggccagtcaaattgtacccgcgactacttagcctggtaccagcagaaacctggccaggcctcccagacctcctcactccacaatatattctacgagggccgcgggcatcccagacaggttcagtggctaggtgggtctgggacagtaccttcacgtctcgacctatacagcaagacgtggacgccgtaggtaaagttatttagactaagtagttaattacgtgtacgagtactaaattatcgacctcccgtaacccccgtatacccgtaacccgtttcccggaacccgaacggggtacctaaccggacttacgaccgaaagtacgtaacggtaaaaccgtacggtcggtacgaccgttacgacctaaccacttcgttacgttcttaccg

SEQ ID NO: 174854 - DNA, 627 bp, Homo sapiens
  misc_feature: GYAE6OF01BB4LZ.21.33.C11.1.454.CMB.1.raw
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgctccgaggggacagagccaccctctccgtgcggggccagtcaaagttcgttacccgcgactacttagcctggtaccagcaagaaacctggccaggctccagactccnactccaanaatatattcgtacacgggccgcggcactcccagacgtaggtnagtggacaggtcgggtactgggacagtactcactctacaccagtcgagcaggacgtcggaggtacccgtagaaacgttacgttttgaccgtaatttacgttaatttacgtcgtacagtacgtaatacgtgcctaccgacccccgtagtaccctacccgttaccggaaccgaacgggacctaaccggacgtacggaccgtaaggaaccgtaaggaaacccgtaacgttcgggtacgtaccgtcgtacccgtaaccgtattcgttacggttccttaaccg

SEQ ID NO: 174855 - DNA, 708 bp, Homo sapiens
  misc_feature: GYAE6OF01EQD9D.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgcccaccctctccgtggcgggccagtacaaatttcgtacccgcgtactacttagccgtaggtaccagcaacgaaccgtggcccgacggcctacccgagtacctcctcactacccaactaaattattacttaccgtacggacggggcccgacgggaccactacccgaagacgtaggttaccgaggtcggacgtaggtcgggtcgtagggactacgtacttccactctaccacctatcgaacgacgaacgtacgtgggaacgtacctaggtaaagttacgttttaggacttaaagttacgtttaactttacgttacgtacgtaacgtaactaaagttacctccgtacccgtacccccgtaacccccgtactacccgttacccggttaccggaaccgaacggtaccaccgtacgtacgacgtaacgtaacgtaaccggaaacgttacggtcggtacgtccgaacgtacctaacgttacttcgtttcgttaccgtttacccg

SEQ ID NO: 174856 - DNA, 630 bp, Homo sapiens
  misc_feature: GYAE6OF01CC4GS.21.33.C11.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgccaccctctcctgccggggccagtactaaagttcgtacccgcgtacttacttagcctggtaccagcagaaacctggccaggctccagactcctcactccanaatatacttctacgacggccgcggcactccagactaggttcaggtcgacgagtcgggtctgggacagtacttcgactcgtacaccatcgagtacagacgtaggacgaccgtagtaacgttatttacgaactaagtagttacgttacgtagtacgacgtactaacgtatacgtcctacccgaacccccgtatacccgtaccgttaccggaacccgaacgggtaccaccgtacgtacgaccgtaaggacgtaaacggtaaaccgtaacggtcggtacggtacctacggtactaaccctagttacctcgttccttaacccg

SEQ ID NO: 174857 - DNA, 603 bp, Homo sapiens
  misc_feature: GYAE6OF01EIQ73.21.33.C11.1.454.CMB.1.raw
tcagtcgtcgctcgcacgaccggtgctcgatttagagtgagctcgttgggtttggggggggaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccaccctctccgtggccggggccagtacaaattcgtacccgcgtactacttagcctggtaccagcaagaaacctggccaggcctcccagacctcctcatccaacaatatattctacgacgggccgcgggcactcccagacaggttcagtggcaggtgggtctgggacagacttcactctacacatcagcagactggacgcctagtaagtattttagactaattgtaatttactagtacagtactaattactcgacctacccgaaccccccgtatacccgtacccgttaccgggaccgaaacgggaccaccggtacctgacgaagtaacgtaacggaaaaccgtacgtaggtcggaccgtacgaccgtacctacttcgtcgttccttctaccccg

SEQ ID NO: 174858 - DNA, 815 bp, Homo sapiens
  misc_feature: GYAE6OF01ASXDK.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctccccagaaacccaccggagagattgtgttgacgcagtctccaggccaccctgtctttgtcctccgaggggacagacgcccaccctctccgtggccggggccagtactaaattcgtacccgcgtactactagcctacggaccagcaacgaaccgtcggaccacggtcctacccgagtacccttccctacactaccccaactaaacttacgttaactttaccgtaaccggaccgggggcccgccggggacctaaccgtcccccgaaggaaccgtacgggtttaccagggtcgggaccgtaggggttcgggtacgtcggggaaacctacgtacccgtttccgaccttacccgtaccaacccgtattaccgacgaccgtaacggtaccgtacgggtaccgtaccgttaggttaaacgtttaccgttttaggaaccttaaagtttacgtttaacgtttaccgttacgtaccaacggtaactaaacttcggttaaccgaccccttaacccccgaaccccccgtacgttacccccgttaaccccgggttaccgggaacccggtaacccgggaacgaacccggtaacgtcggtaaccgaaacggtaacgtaaccgggtaaacgtaacggtccggtacggtaccgtaacgtaccctaaccttagttccgttccgttaccttacccg

SEQ ID NO: 174859 - DNA, 814 bp, Homo sapiens
  misc_feature: GYAE6OF01D2FUL.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagtattgtgttgacgcagtctcaggcacctgtctttgctccgaggggacagacgccaccctctccgtgcggggccagtacaaattcgtacccgcgtactacttagcctaggtaccagcacgaaaccctggccagggccctaccgagacctcccctcactcccaactaaattacgttactttaccgtaaccggacgggggccccggccggggtaccaacgttcccccgaaagtaccgtacgggtttaccaaggtcgggaccgtagggtcggggtctacgggggaactacgggtaccttaccaccgttcctaccaaccctagttaccgaacggtacgacggtaaccgtacgggaccggtaccgttaggtaaacggtttatttttacggaactaaacgtttacggtttaacttttacgtacggttaacaacggtaactaaactttacggtccgtacccttaacccccgaaccccccgtaacgtttccccgtaaacccggtttcccgggaaacccggaaaccgggtaacccgaaccggttaaccgtaccggtaaccgaacggtaaacgttaaacgggtaaaaaccgtaccggttacgggttaccgggtacgttaaaccggtccgtaaacccttaacgtttccgttcggtttacctttaaccccg

SEQ ID NO: 174860 - DNA, 836 bp, Homo sapiens
  misc_feature: GYAE6OF01DR6NW.21.33.C11.1.454.CMB.1.raw
tcagtcgtcgctcgcacgaccggtgctcgatttagagtgagctcgttgggtttggggggagaagagctgctcagtcaggacccagagggaaccatacggaaaccccagcgcagcttctccttcctcctgctactctcggcctacccgaacgaaacccgaccggagagtattggtagttcgacgctacgtcctccgacggcctacccgttgtttcgtttcgtaccgtaccggaagggggaccacggaccgtcccctaccccgttcctccggtcgggccggggacctaacggttacctaaacgttttccggtaaccccggacgtaaccttaccgttacggccgttacggtaaccaggtaccaaaccggtaaccgtcggacccgacggtaccctacccgaacgtacctccctcaacctacctaaactaacgtttacttacgttaccgaaccggccgggacccgtcgggaccaacctaccccgagtaccgtacggttcgacggtcggcgtacgggtcgggtacggtacgggtactacgttacctaccgtacctactaccgacctacgtacgacgtacacgtacggtacggtacgtccgttaaggtaagtttactttacgagttaacttaggtttaacttacggtacgttaacgaacgtacgtttaactaccggttaccgtaccccccgttaaccccgtaacccccgttacgtaccccggtttaacccggttaacccggaacccgggtaaacgggtacctaccgttacgacgtacgaaacgtaacgaacggtaacgtacggtcggtacgcctacgccgtaccttatccgttctcttacccg

SEQ ID NO: 174861 - DNA, 548 bp, Homo sapiens
  misc_feature: GYAE6OF01A7JJE.21.33.C11.1.454.CMB.1.raw
  modified_base (398)..(398): a, c, t, g, unknown or other
  misc_feature (398)..(398): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgcggggccagtcaaattcgtacccgcgactacttagcctggtaccagcagaacctggccaggctccagactcctcactccacaatatattctacgagggccgcgggcactcccagacaggttcaggtggcaggtgggtctgggacagacttcactctcacatcagcagactggacnctagaagtatttgactaatgtattactgtcagtactaatactcgtcctacccacccccgtatacccgtacccgttccgaaccgaacggaccacgctacgactagacgtacgaacgagtcgtacgctacgaccactactcgtgtcttaccg

SEQ ID NO: 174862 - DNA, 610 bp, Homo sapiens
  misc_feature: GYAE6OF01AYEVT.21.33.C11.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctcccagaaaccaccggagagattgtgttgacgcagtctccaggcaccctgtctttgtctccgaggggacagacgccaccctctcctgccggggccagtcaaattcgtacccgcgactacttagcctggtaccagcaacgaaacctggccaggcctcccagacctcctcactaccaactaatatacttcctacacgggtccgcgggcactcccagacaggttcaggtgcagtggtcngggacagacttcactctcaccatcagcacgacgtggagtccgtagaagtattttcgactaagttagtacttacgtgtacagtactaagttactcgtcctaccccgaacccccgtacttacccgtaacccgttaccggaccgtaaacggaccaaccgtacgtacgacgaacgtacgtaacgaaaccgtaacgttcggtacggtacctacgaccctaactacgtccttgttcccttaccg

SEQ ID NO: 174863 - DNA, 825 bp, Homo sapiens
  misc_feature: GYAE6OF01BST66.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggcctcccaagaaaccaccggagagattggtgttgacgcagtctccaggcaccctgttctttgtcctccgaggggacagacgcccaccctctccgtggccggggaccagtactaaagtttccggttaaccccgcgtaaccttacgttacgcccgttagggtaaccaggaccaaacggtaaaacccgtcgggacccaacgggtccctacccgaacggtaccctaccctaccaactacccaaactaaacttaacttacttaccgtaacggaccggggtcccggaccggggtacctaaccgtaccccgaaggtaaccgtaacgggttacaagggttcggacgtagggttcggggtacgtacggggaacctaacgtacccttacgtaaccttcctaccaaacccgtagtaccgaacggtaccgtaacggtacgtacgggacggtacgttaggtaaagtttacgttttacgacttaaagtttagtttaactttacgtacgttacgtaacgtacctaaatacgtaccgtaccctaacccccgtaacccccgtacgttacccctaacccggttaccggtaaccggaacggtaccgaaccgtaccgtacgacggtaaacgtaacggtaacggtaaaccgacggttcggtaccgtaccgtacgtaaccctaactaccgtttacgttcgttccttaacccg

SEQ ID NO: 174864 - DNA, 667 bp, Homo sapiens
  misc_feature: GYAE6OF01DCHBE.21.33.C11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaagaaaccaccggagagattgtgttgacgcagtctccgaggcaccctgtctttgtctccgaggggacagacgccacctctccgnggcggggccagtctaaagttcgtacccgcgactacttagcctaggtaccagcaacgaaacctggaccaggcctacccagtacctcctacactaccaactaataatacttaccaacgcggccgcggaccactcccagactaggtcaggtcggctaggtggtctagggacagtacttcactctaccacatacagacaagtacgtaggacgaccgtagtaagttacttttacgaactaagttagttaactttacgtacgttacgaacgtaactaaacgttagtacgtacccgtaccccgaacccccgtacgtaacccgtacccgttaccgggaacccgtaaacgggaccgaaccgtacgtacgacgaagtaactaaacggaaaaccgtaacgttacggtacggtacctacgtacccgtaactacttacgttccgttaccttaccg

SEQ ID NO: 174865 - DNA, 679 bp, Homo sapiens
  misc_feature: GYAE6OF01BELD1.21.33.C11.1.454.CMB.1.raw
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctggccggggccagtcaaattgttacccgngactactagcctggaccagcagaacctgcagctccagactccacactccanaatatacttcacgacggccgcggcactcccgaagacgaggttcagtcgcgtaggtcgggtcgtaggggaacaggtacctttcaaccgttctaccaccgtatccgagacagaccgtaggacgtaccgtaggaaagttagttttacgacgtaattaggtttaactttacgtcgtacgtaacgtaactaagttactacgtacccttaccccaacccccggtacttaccccgtaacccgttacccggaacggaaacccggtaccgaaccggtaacctaccgggaccgtaaacggtaacgtaacggtaaaaccggtacggttacggtacgggtaacccgttacgacccgtaaccgttaatttcccgtacgttccgtttaaccc

SEQ ID NO: 174866 - DNA, 524 bp, Homo sapiens
  misc_feature: GYAE6OF01D2IB2.21.33.C11.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctgccaggctcccagactcctcatccacaatatattctacagggtccncgggcatcccagacaggttcagtggcagtcgggtctggggacagacttcgactctcaccatcagcagactggacgcctgaagtattttgactaatgttattactgtcagtcaatatgctccacccccgatcctaccttcggaccaacgggacacgacgtgccagactacgaaacgaacgtgcgctcgccaccatctcgtcttac

SEQ ID NO: 174867 - DNA, 586 bp, Homo sapiens
  misc_feature: GYAE6OF01DJJWP.21.33.C11.1.454.CMB.1.raw
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (570)..(570): a, c, t, g, unknown or other
  misc_feature (570)..(570): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaagaaaccaccggagagattgtgttgacgcagtctccaggcaccctgtctttgtctccaggggacagacgccaccctctcctgccggggccagtcaaattcgttacccgcgactacttagcctggtaccagacagaaacctggccaggcctccagtactcctcatccanaatatattctacgacgggccgcgggcactcccagacnggttcagtgcagtggtctgggacagacttcactcacaccntacagacagacgtaggacgtaccgtagaacgtattttgactaaagttgttattactgtacgagtactaatacgtacgtaccctacccacccccgtatacccgtaccgttaccggacccgtaacgggaccaccgtacgtcgacgacgacgtaacgaaacgtacgtagtcgtcgtacgacccacnttcgtcgtcgttaccg

SEQ ID NO: 174868 - DNA, 778 bp, Homo sapiens
  misc_feature: GYAE6OF01CR1J6.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggcctccagaaaccaccggagagattggtgttgacgcagtctccaggcctacctgtctttcgtctccggaggggacaggccgccaccctctccgtggccggggacctagtactaaagttccggttacccgcgtaaccttacgttacgccgttacggtaccagacctaacgaaaccgtcgggaccaaggtccctaccgaacgtacctcctacactaccaactaattactttacgtaccgtaacggacgggcccggtacgggtacacctacccgaagtaccgttagggtaccgtaggtcggacgtacggttcggggtacttacgggggaactacggtactttacgacccgtctaccgaactattacgacggactagggtactacggtacgtaccgttaaggtaacgttttacgtttacgaacttaagtttacgttaacttacgttaggtacctaaggtactaacgttacgtaccgtccccgttaaccccgtaacccccgtaggtaccccttaaccgggtccgtaaaccgggaacgtacccaacggttacgaccgtaacggaacgtaacggtaaacggttaacccgagtttaccggggacgttaccgtacgacccgtaactcgtttaaccgtcgtttcccgttaccg

SEQ ID NO: 174869 - DNA, 632 bp, Homo sapiens
  misc_feature: GYAE6OF01BXPFM.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctgccggggccagtcaaattcgttacccgcgactacgtagcctggtaccagcaagaacctggccaggcctacccgagacctcctcatccactaatactacttctacgacgggccgcggccactcccagtacacggttcaggtgcaggtggtctacgggacaggtaccttcgactctacacctatcgaagcaagacgtaggacgccgtagtaagttacttttacgactaagttcgttacttacgttgtactagtactaacgtatcgtcctaccgaacccccgtactccgtaccgttaccggaccgtaacgggacccaaccggtacgtacgaccgaaacggtacgtaacggaaaccgtaacggtcggttacggaccgtacggtaccctaacctacgtcgttccgttcttacccg

SEQ ID NO: 174870 - DNA, 573 bp, Homo sapiens
  misc_feature: GYAE6OF01BU62E.21.33.C11.1.454.CMB.1.raw
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (461)..(461): a, c, t, g, unknown or other
  misc_feature (461)..(461): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccacctctcctgcggggccagtcaaattcgtacccgngactacttagcctggaccagcagaaacctggccaggctcccagactcctcatccacaatatattcacgagggccncgggctactcccagactaggttcaggtggcaggtggtctagggacagtactcactctcacatcgagcagctggagcctagaatatttgctaatgttattacgtgtactagactaatactcgtacctccctaacccccgtntacccgtaacccgttaccggaccgtaacgggaccaacggaccgtagaccgaagtacgtaacggtaaacgtagtcgtagtaccgtcgaccgtacccacttcgtgttccttacc

SEQ ID NO: 174871 - DNA, 643 bp, Homo sapiens
  misc_feature: GYAE6OF01BTA77.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaaacctggccaggctcccagactcctcatccacaatatattctacgagggccgcgggcactcccagacaggttcagtggcaggtggtctgggacagtacttcactctcactatcagcagactggacgcctaggaaagttagttttacggactaaagttagttaactttaacgtgttaccaagtactaaagttacgtacgtcctaccccgtaaccccccgtacttacccgtaaccccgtttaccgggaacccgtaaacggggtacctaaccggaaccgttacgaccgtaacggaagtaaccggtaaaaccggtaaacgttcggtacggtaccctacggtaccaacccgtaattccgttaggttccttaacccg

SEQ ID NO: 174872 - DNA, 701 bp, Homo sapiens
  misc_feature: GYAE6OF01D481I.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaagaaaccaccggagagattgtgttgacgcagtctccaggccaccctgtctttgtctccgaggggacagagcccaccctctcctggccggggccagtcaaattcgtacccgcgactacttagcctggtaccagcaacgaacctgccaggcctcccagacctcctcactccaacaatatacttctacgacgggccgcgggcactacccgagacgtaggttcaggtggacgtaggtcgggtcgtagggacagtaccttcactcacacataccgagacagacgtaggacgaccgttagtaaagttacttttaggaacttaaagttacgtttaacgtttaacgttcgtacgtaacgtacgttaaattacgttacgtacccgtaccccgtaacccccccgtaacgttaccccgtacccgttacccgggtaacccgtaaacggggtaccctaaccggtaacgtacggaacgtaacggtaaacgtaaccgggtaaaaacggtacgttacggggtacgtaccgtaccggtaccgtaaacccgtacgttaccgtttcgttccttacccg

SEQ ID NO: 174873 - DNA, 681 bp, Homo sapiens
  misc_feature: GYAE6OF01C7VLA.21.33.C11.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctccagaaaccaccggagagattgtgttgacgcagtctccaggccacctgtctttgtctccgaggggacagacgcccaccctctcctggcgggccagtcaaattcggtacccgcgtactacgttagcctggtaccagacacgaaacctgaaccacggcctcccagacctcctcactccaacaattatatctacgacgggtccgcggcactccagacagttcagtcggnaggtgggtcgtagggactagtacttacgactctcgaccatacacgacagacgtacggacggtaccgtagtaaggttattttcgaacttaaagtcgttaacttacgttacgtactacgtactaaattacgttaccgaccctaccccgtaaccccccgtacgtacccgttacccgtttaccgggaacccggttaaaccgggacgtaaccgtaacgtaccgtaacgacggtaagtaaaccgggaaaccggtaacgttcggggtaacggttccggtaacgtaccccgtaacccttagttacccttcgttacctttaacccg

SEQ ID NO: 174874 - DNA, 688 bp, Homo sapiens
  misc_feature: GYAE6OF01CZEFC.21.33.C11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagagtgagctcggttggggtttgggggggagaagagctgctcagtcaggacccagagggaaccatggaaaccccagcgcagcttctcttcctcctgctactctggctccagaaaccaccggagagattgtgttgacgcagtcctcaggcaccttgtcttgtctcgagggacagacgccacctctccgnggcgggccagtactaaaattcgtacccgcgactacttacgcctaggtaccagacaacgaaacctggaccgaaggcctacccacgacctcctcatccaataatattactctaacgacgggccgacggacactaccagacgtaggttacaggtgaccagggtcggtacgtaggaactacgacttccaactcgtacacctatacgataccgaagtcgttacggacgtaccgtaggtaaagttacgttttacggaacgttaaagtttaggttaactttaacggttacgttaaccgtaagtaacttaaacgttacttacgtacccgttaacccccgaacccccggttacttacccgtaacccgttaccggaaccgggtaaacggacctaacggtaacgtacgacgtaacgagttaaacggaaactacggtggaacgccgtaacgacctaactattactcgttcgtttaaccc

SEQ ID NO: 174875 - DNA, 673 bp, Homo sapiens
  misc_feature: GYAE6OF01C0YRQ.21.33.C11.1.454.CMB.1.raw
  modified_base (256)..(256): a, c, t, g, unknown or other
  misc_feature (256)..(256): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggcctcccagaaaccacggagagattgtgttgacgcagtctaccaggccaccctgtctttgtctccgaggggacagacgccaccctctccgtggcggggaccagtacaaattcgttacccgngtactacttacgccgtaggtaccagcaacgaaacctggaccaggcctcccgagtacctcctcactaccaactaatatacttacacgacgggccgcggaccactaccccagacgtacggttcgaggtcggctagggtcgggtacgtacgggggacacggtacttcgacctctaccacctataccgagacgagtacgtgggacgtccgtaggtaaattacgttttaggaacttaaagttgtaactttacgtagtacgtaagaacctaattatccgtaccgtacccctaacccccgtactacccgtaacccgttccggaaccgtaacgggaccaaccgtacgtacgcgaagtaacgtacggaaacgtaaccgtgggtaccgtcgtaccgtacgaacttacttccgttcgttccgttaccg

SEQ ID NO: 174876 - DNA, 662 bp, Homo sapiens
  misc_feature: GYAE6OF01AOKNE.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccagggacagagcccaccctctcctgcggggccagtcaaattcgtacccgcgactacttagcctggtaccagcaacgaaacctggccacggcctcccgagacctcctacactccaacaatatacgttctaccgagggccgcggcacgtaccccgagactaggttcacggtggctaggtcgggtcgtaggggaccaaggtactttcaccttccgttaccgaaccattccgacggacacgtaccgtggtaacgtccgttaaggaaagtttacgttttacgacttaattaggttaactttactaggtaccaacgtactaatacgttcgtaccttacccgaacccccgtacgtccctaacccggttaccggaacccggtaaccggaactaccgaacgtcgacgtaacgtaaccgtaacgaaaccgttacgtcggtaccgcgtacgaccctacacgttctcgttccttaccg

SEQ ID NO: 174877 - DNA, 637 bp, Homo sapiens
  misc_feature: GYAE6OF01EPK8X.21.33.C11.1.454.CMB.1.raw
tcagtcgtcgctcgcacgaccggtgctcgatttagagtgagctcgttgggtttgggggggagagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctgcggggccagtacaaattcgtacccgcgactacgttagcctggtaccagacacgaaacctggaccaggcctcccagacctcctcactccaacaatatattactacgcgggccgcgggcactccagacagttcagtggcaggtgggtactgggacagtaccttcacctctaccactatacagcaagtacgtaggacgtccgtaggtaacgtatttagactaaagttagttactttaattcgtactacgactaatactcgtacccgttacccaaccccccgtattaccctaccgtttaccggaacccgtaagggacccaacggtaccgtacgaccgtaacgtaacggtaacgtaaaacggtacgttacgggacgtacctacggtaccctacgtacttccttacgttcgttaacccg

SEQ ID NO: 174878 - DNA, 674 bp, Homo sapiens
  misc_feature: GYAE6OF01EX1LG.21.33.C11.1.454.CMB.1.raw
  modified_base (322)..(322): a, c, t, g, unknown or other
  misc_feature (322)..(322): n is a, c, g, or t
  modified_base (489)..(489): a, c, t, g, unknown or other
  misc_feature (489)..(489): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctccgtggcggggccagtcaaattcgttacccgcgaactacttagcctggtaccagcaagaaacctggcccagcctcccagacctcctcactccaacaatatacngtctacgacggccgcggcactaccgacgacgtacggtacgaggtggtcgtaggtcggtacgtacggtacgacgtacttactacctacctaccaccactacgacgacgaacgacgtacggtacgtaccgttagtaaacgttaagtttacgacttaagttacgttaacntttacgttacgtacgtaacgtaactaaacttacgtacgtaccctaccccgtaacccccgttaccgttaccccgtaacccgttaccggtaacccggtaaaccgggtaaccgaaacccgtacgacgacgtaagtaacgtaaacggtaaacgtaacgtacggtacgtacgtacgacctaccgtacgtc

SEQ ID NO: 174879 - DNA, 670 bp, Homo sapiens
  misc_feature: GYAE6OF01B3F4Z.21.33.C11.1.454.CMB.1.raw
tcagtcgtcgctcgcacgaccggtgctcgatttagagtgagctcgttgggtttggggggagaagagctgctcagtcaggacccagagggaaccatcggaaaccccagcgcagcttctcttcctcctgctactctggctcccaagaaaccaccggagagtattgtgttgacgcagtctccaggccaccctgtctttcgtcctcgaggggacaggacgcccaccctcctccgtggccggggcctagtactaaagttccgtacccgcgacttacgttacgccgtcggtaccagaccaacggtaaacctggaccaaggtccctaccgaagaccttcctcaacttaccaactaattactacttccgacgacggggccgacggcacgtaccaggtactaggttcaggtggacgtaggtcgggctaggggacaggtaccttccaacgtcctacgtaccacgtacaacgtccagtaccggtcgaacgtccgttagtaaacgttagtttacgaactaagtttacggttactttaacgtgtaccgaagtctaaattctccgacctaccccgtaacccgtctacctaccggtccgaacgaacgggacaccgatcggactacgtacgtaacgaaaccgtggtacgtacggactacggtacctacgtactcgttctcgttacc

SEQ ID NO: 174880 - DNA, 676 bp, Homo sapiens
  misc_feature: GYAE6OF01EF7C2.21.33.C11.1.454.CMB.1.raw
  modified_base (126)..(126): a, c, t, g, unknown or other
  misc_feature (126)..(126): n is a, c, g, or t
  modified_base (472)..(472): a, c, t, g, unknown or other
  misc_feature (472)..(472): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctnctactctggctccacgaaaccacggagagattgtgttgacgcagtctccgaggcctaccctgtctttgtcctccgagggacagacgcccaccctcctccgtggccggggccaacgtactaaacgtttcgtaccccgacgtaaccttacgttacgtccgtacggtaaccagacaacgtaaacccgtgggacccacggcctacccgaacgtaccttcctacactaccaactaatacgttacttaccgtaaccggacggggtccggcggaccactcccgaagtacgtacggttcgaggtcggcgtaggtcgggtcgtacggactacgtaacctcactcgtacacctaancagacgtagtacgtacggacgtacgtagtaacgttatttcgaatagttgttattacgtagtacagtaactatacgtcgtaccctccccgaaccctctaccgtaccgttacgaccgaacggacctacgacgtgaccgtagacgtaaacggaactacggtggtaccgacgtaccgcctaaccgtacttacgttacgttcttacccg

SEQ ID NO: 174881 - DNA, 584 bp, Homo sapiens
  misc_feature: GYAE6OF01AXJL7.21.33.C11.1.454.CMB.1.raw
  modified_base (519)..(519): a, c, t, g, unknown or other
  misc_feature (519)..(519): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgcggggccagtcaaatttgtacccgcgactacttagcctggtaccagcagaacctggccaggctcccagactcctcatccacaatatacttcaacagggccgcgggcatccccagacctaggttcagtgcgtagtgggtctgggacagacttcactctcactatcagcagacgtcggacgccgtagaagtactttagactaagttgttaattaccgttagtcagctaagttatacgacctaccctaaccccccgacttacccgtacccgttaccggaccgtaacgggaccaccgtacncgtcaacggataacgaaacgtaacgttcgtcggactcgaccacctacttccttcgttcgttaccc

SEQ ID NO: 174882 - DNA, 615 bp, Homo sapiens
  misc_feature: GYAE6OF01CEEZY.21.33.C11.1.454.CMB.1.raw
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (551)..(551): a, c, t, g, unknown or other
  misc_feature (551)..(551): n is a, c, g, or t
tcagtcgtcgctcgcacgaccggtgctcgatttagagtgagctcgttggggtttggggggagaagagctgctcagtcaggacccagagggaaccatggaaaccccagcgcagcttctcttcctctgctactctggctccagaaaccaccggagagattgtgttgacgcagtctccaggcaccctgtctttgtctccgtggggacagacgccaccctctccgtggccggggccagtcaaattcgttaacccgcgactacttacgcctggtaccagcaacgaaacctggccaggcctcccagacctctcactccacaatnttatctacgacggccgcggcactcccagactaggtcagnggcaggtcgggctgggacngatcactctcaccatcagcngactggacnctagaacgtatttcgactaacgttggtaatttacgtcgttacgacgtaactaaattagtacgtacccttacccgaaccccccgttagtacccctacccgtttccgggacccgtaaacgggtacccacggttaacgcgtacgaacgngtaaaccgaaaacgtacgtgggttacgaccgtacggtccaacgttatccttcgttccttacccg

SEQ ID NO: 174883 - DNA, 724 bp, Homo sapiens
  misc_feature: GYAE6OF01EEYZS.21.33.C11.1.454.CMB.1.raw
  modified_base (398)..(398): a, c, t, g, unknown or other
  misc_feature (398)..(398): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctcaggcaccctgtctttgtctccgaggggacagacgccaccctctccgtggcgggcagtacaaatttcgtacccgcgtactacttacgcctggtaccacgacaacgaaaccgtcggccacggtcctacccgagacctccctacactccaactaatattacttccacgacgggcccgacgggacacgtcccagtactacggttcaggtcggacgaggtgggtacgngggacagaccttcacgtactaccacctatcgacgactacggacgtgggaacgtccgtaaggaacgttacgtttaccggacgttaacggtttacgttaacgtttaccgttgtacccgtaagtaccgttaaggtttacggttaacgggttaacgtttaccaaccgtttcgttccgggttacccgtttccgggaacccggtaacggggtaacccgtaaaagggtaaccggtaaaagtaccgggtaaaacggttacgtcgggtttacggaccggttcgacccgtaactaactttcggttacgtttaccttcttacccgtccgttaccccg

SEQ ID NO: 174884 - DNA, 868 bp, Homo sapiens
  misc_feature: GYAE6OF01ESHEM.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctcccagaaaccaccggagagattgtgttgacgcagtctcaggcaccctgtctttgtctccgagggacagacgccacctctcctggccggggccagtactaaacgtttcgttacccgcgtacttacgttacgcctacggtaaccaggtccaaacggaaaccgtcgggacccacgggtaccctcccaagtacccttcctacaacttacccaactaattactactttaccgtaacggacgggggcccgtacgggacctaccgtaccccgaagggtaccgtacggttttacaacgggttcgggtaccgtaaggggttcgggggttaccgtagggggtaacctacgggtaccctttaccgaacctttctacccgaactacgttaccgaggaccgtaacggtacggtcgggtaaccggtcccgttaaggtaaacgttagttttaacgggactaaaggtttacgtttaacgttaaccgttaggttacctaaacggtaactaaacgtttcgtaaccgttacccgtaacccccgttaaccccccgttacgttaacccgttaaccccgggtttacccgggaaacccggtaaacgggggtaaccctaacccgggtaacgtaccccgggtaacgtaaaccggtaaacggttaaaccgggtaaaaaccggtcggttacgggttaccgaccgttaaccgaaacccggttacccttaaacgttcccgttacgtaaccggtttaaccc

SEQ ID NO: 174885 - DNA, 802 bp, Homo sapiens
  misc_feature: GYAE6OF01DDI1Y.21.33.C11.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagagtgagctcgttggggtttgggggggagaagagctgctcagtcaggacccaggagggaaccatacggaaaccccagcgcagtcttctcttcctctgctactctggcctcccaagaaaccacggagagtattgtgttgacgcacgtctccgaggcctacctgttctttcgtctacggagggacaggacnccacccttcgccgtggccgggtacagtactaacgttcggttacccacgtaccttacgtcgtaccgtacggtaaccagtacgaacgaacgtcggaccacggcctacccacgtcctccacacctaccaattaatcttaacttcgaaccggcggcccgtcggactaaccgtccgaacggtacgtacggtcagggtcggtacgtacggttcgggacggtaggaactcgtaccttacacgttaccacgtactagaccgaagtccgtaagggtcgtacgggaagtccgttaaagtaaccggttttgtttaaccgaattaacggtttatttaaaccgttaccgtacgtaacgtaacgttacctaaacgtttcgtacgtaccccccttacccccgggtaaaccctcgttacccgttaaaccggacccgggaaccgaaacgggtacccgaaacttcccggagaaccgtaaaccgggttaagtaaaccggggtaaaacccgtgggttttcccggaaacggtacccgggtttacccgaaaccccctttagttaccggtttaacccctttcccgttaaacgttaacccccg

SEQ ID NO: 174886 - DNA, 706 bp, Homo sapiens
  misc_feature: GYAE6OF01BHWB7.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaagaaaccaccggagagattgtgttgacgcagtctccaggcaccctgtctttgtcctccgaggggacagacgcccaccctctccgtggccggggcccagtacaaattcgtacccgcgtactactagcctaggtaccagcaagaaaccctggacccaggcctacccagtacctcctcatacccaacaatactattcctacgacgggccgcgggcacgtcccgagactaggttcaggtcggctaggtgggtcgtaggggaacctaggtaccttaccacgtccctacctaaccgtattccgagtaccgtaacggtaaccgtcggggaaccgtcccgttaaggtaaagttacgttttacggacttaaagttcgttaactttaccgttgtacagtaaccgtaattacgtcgtacccgtacccccgaaccccctagtaccccgtaccgttccgggaaccctaagggaccctaacggtacctggacccgtaaagacgttaacggaaaacctacggtcggtacggtacctaaccggacctacccgttaagttccgttacgtccgtttaacccg

SEQ ID NO: 174887 - DNA, 754 bp, Homo sapiens
  misc_feature: GYAE6OF01BPVZB.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctccgtgccggggccagtactaaagttcgttacccgcgtaccttacttacgcctaggtaccagacacgaaacctggacccacggcctccgagacctcctactactaccaactaattactaacttaccgtaacggacggggcccggacggggacctacgtaccccgaaggtaccgtacgggtttaccagggtacgggacgtaacgggttcgggggttacctacggggggaaacctacgggtacccttttacccaacgtttccccgtaaccgaccctaacgttaccgaacggtaccgtaacgtaccggtacggggtaccgtacccgttaggtaaacggtttacgttttacggaccgttaaagtttacggtttaactttacgtcggtacctacgtacgtaatacgttcgacccttaaccccgacccccgtactacccgtaacccgttccggaacccggaacgggtaccaccggactcggacgacgtacgaacggtaaactacgtggacgacgtcgtactacgtactcgtcctcttaccg

SEQ ID NO: 174888 - DNA, 874 bp, Homo sapiens
  misc_feature: GYAE6OF01DI07J.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctccagaaccaccggagagtattgtgttgacgcagtctccaggcacctgtctttgtctccgaggggacagacgcccaccctctccgtcggccggggacctaggtacctaaagtttcggttaccccgcgtaacttacgttacgccgtaggtacccagtaccgaacgtaaaacccgtcggacccgacgggtcccttacccgaacggtaccttccccctactaacctacccctaaacctaaatttaacttaacgtttacccgtaaccggtaacgggggtcccccggaccgggggtacctaaccgttaccccgaaaggtaaccgtaacgggttaccgaagggtcgggtaccgtaagggtttcggggtacggttacggggaacctacgtaacgttaccgtaccttcctaaccgacctaagttccgaaggtaccgtacggtaaccgttacgggaccgtaccgttacggtaaacggtttaacgttttaggaacgttaaagtttccgggtttaactttaccgttacggttacgtaacggtaacttaaacgtacggttaccgtacccgttacccccgaaccccccgttaattaacccccgttacccgtttacccggtaacccggtaaccgggaacctaaccgtaaccgtacggaccgtaacggtaacgtaaacggtaaaccggtaacggtcgggtaacgtacccgtacgtaacccgaccgttacgtttacgtcgttacgttaacccc

SEQ ID NO: 174889 - DNA, 636 bp, Homo sapiens
  misc_feature: GYAE6OF01ASMU5.21.33.C11.1.454.CMB.1.raw
  modified_base (390)..(390): a, c, t, g, unknown or other
  misc_feature (390)..(390): n is a, c, g, or t
tcagtcgtcgctcgcacgaccggtgctcgatttagagtgagctcgttgggtttggggggaggaagagctgctcagtcaggacccagagggaaccatggaaaccccagcgcagcttctcttcctcctgctactctggctcccagaaaccaccggagagattgtgttgacgcagtctccaggcaccctgtctttgctccgaggggacagacgccacctctcctggcggggccagtctaaattgtacccgcgactacttagcctggtaccagcagaacctgccaggctcccagacctcctcactccacgatatattctacgaggccgcggctactcccagacaggtcagtggcaggtgggtcctgggacaggtcttcgactcgtaccacatcncgacaagaccgtaggacgtacctaggtaaagttacttttacggacctaagttacgtttacgttaccttacggtctaacggtactaacttacgtaccggcctttaaccccgaccccccggttatacccggttaccccgtaccggttacccgaacggtaaccgacccggtactcggaccgtaagtacgtaacggaaaccgtagttacggacggtccgtacgtaccgacctacgtcttcgtcgttaccg

SEQ ID NO: 174890 - DNA, 583 bp, Homo sapiens
  misc_feature: GYAE6OF01DM5MP.21.33.C11.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccagaaaccaccggagagattgtgttgacgcagtctccaggccaccctgtctttgtctccgaggggacagacgcccaccctctcctggccggggccagtacaaattcgtacccgcgtactacttagcctggtaccagcacgaaacctcggccacggcctacccagacctcctcactccaataatatattctacgacgggccgcggcactcccagactaggttcagtggacaggttcggtctgggactagtacttcactctacaccatcgagcagacgtggacgctagaagtntttagactaatgttacttagtcgtactagactaatactgaccctacccaaccccgtactcccgtaccgttacgaccgaacgggacctacgactcgacgagaacgtaacggtaaacacgtggacgtcgctacgaacattacgtgttccttacg

SEQ ID NO: 174891 - DNA, 750 bp, Homo sapiens
  misc_feature: GYAE6OF01DISVH.21.33.C11.1.454.CMB.1.raw
  modified_base (625)..(625): a, c, t, g, unknown or other
  misc_feature (625)..(625): n is a, c, g, or t
  modified_base (644)..(644): a, c, t, g, unknown or other
  misc_feature (644)..(644): n is a, c, g, or t
  modified_base (689)..(689): a, c, t, g, unknown or other
  misc_feature (689)..(689): n is a, c, g, or t
tcagtcgtcgctcgcacgaccggtgctcgatttagagtgagctcgttgggtttggggggagaagagctgctcagtcaggacccagagggaaccatacggaaaccccagcgcagcttctcttcctcctgctactctggcctccaagaaaccacggagagtattgtgtgacgcagtcctaccgaggcctacccgttgttcctttcgtaccgtccggaaggggtaccaggaccgccctacccgtcgtccgtggccggggacctaacggtactaaacgtttccggttaaccccgacgtaaccgttaacgtacgcccgttaggaaccaagacgaaacgtaaaccgtcggaccgtacggacctcccgaagtaccctcctaccactaccaactaactataccttacgtaacggtacgggcccgtacgggcctaaccgacccgaggtaaccgtacggttacacggtggactaacggttcgggacgtaggacctaacggtacctttaccggacttaccgacctaacctactaccgtacgaccgaacggtaacccggtcggacgtcccgtaaggttaaacgttagtttacgaacttaagtacgtttaacgtacgttacgtagataacgtacttancgtacctcccgaacccctntcccgtaccaccggtaccgaacggtacgaacgcgtacacggtaanacgtaaagaaccgtacgtcggtacgcgtaccgaacctagaccctttactcgttctacccgg

SEQ ID NO: 174892 - DNA, 612 bp, Homo sapiens
  misc_feature: GYAE6OF01DGP2O.21.33.C11.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggcctcccagaaaccaccggagagattgtgttgacgcagtctccaggcaccctgtctttgtctccgaggggacagacgccaccctctcctgcggggccagtacaaattcgttacccgcgtactacttacgcctggtaccagcagaaaccgtggccaggcctcccagacctcctnactccacaatactacttctacgacgggccgcggcactcccagacgtaggttacaggtggcaggtgggtctggggactgtacttcactctcacatacacgtcagacgtgacgccgtagaagttattttgactaaatcgttaattacgtacgtacacgtactaagttactcgtacctccccaaccccgtactcccgtaccgttaccggaccgtaacggaccaccggtaactcgacgacgtaacgtaacgaaacccggtaagttcgggacgtactacgaccctaacgtacgttctcgttcttacccg

SEQ ID NO: 174893 - DNA, 847 bp, Homo sapiens
  misc_feature: GYAE6OF01E5UA0.21.33.C11.1.454.CMB.1.raw
  modified_base (793)..(793): a, c, t, g, unknown or other
  misc_feature (793)..(793): n is a, c, g, or t
tcagtcgtcgctcgcacgaccggtgctcgatttagagtgagctcggttggggtttgggggggagaagagctgctcagtcaggacccagagggaaccatacggaaaccccagcgcagcttctcttcctcctgctactctggcctaccagaaaccacggagagtattgtgttgacgctacgtcctccgacggtcctacccttgttctttcgtcctaccggaggggaccacgaccgcccctaccccgttccgtccgtcgggccggggtacctaagttacctaaacgtttccggtaccccgacgtaaccttacttacggccgtacggtaccacgacgaacggtaacccgtcggaccgaacggccctacccaacgtaccctcctacactacccaactaaacgttactaacgttaccgaaccgggccggggcccggtaccggacctaaccgtaccccgaaggtaccggttacgggtacgtacgggtacgggacggttacgggtcgggtaccgtaacgggaaccttacgtttaccctccgttaacctccgtaaccctaaccgtacgtacggaacggtaacgaacgggttaccggacgggtaaccgttacggttaaggttaaacgtttactttacggaacttaacggtttaacgttaccgttacgtacgaacctaacgtaaccttaacgttccgtacccgaccccttacccccgtaacccgcgttaaccccgttaccgggaacccggacgaaccgggtacaccggcgtaagaccgaaacggtaaccgtaaacgtaaccggnggttcgtaccggacctacgtacccttacgtacttccgtttaccgcctttacccg

SEQ ID NO: 174894 - DNA, 890 bp, Homo sapiens
  misc_feature: GYAE6OF01BBX7E.21.33.C11.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtgagctcgttgggtttgggggaggaagagctgctcagtcaggacccagagggaaccatggaaacccagcgcagcttctcttcctcctgctactctggcctcccagaaccaccggagagtattgtgttgacgcagtctcaggcacctgtcttgtctcgagggtacagacnccgtacctcctccgtcggccggggccagtactaaacgttcgtacccgcgtaacttacttacgccgtaggtaccagccaagaaacctcggaccgacggcctacccgagtacctcctacgactcctaaaccaatactactttcaacgtacgggccgaccggactacgtaccacggactacggttcgaagtccggacgtaagggtcggtacgtacggggaccaaggtaccgtttaccgaacgttcccgtaccgaaacccgtaacgttacccgaaaccggtcgaaaccggtaccggttacggggtaaccgtacccgggttaaagtaaaccggttttaaggtttaccgtaaaccgttaaacggttttgttaaaacccgttttacgtacggtttaacccgtaacggttaaacccgtaagtttaaccggttacccgttaaccccgttacccccgttaaaaccccccccggtaagtttaacccccgttaaccccgggtttaacccgggtaaccccgggttaaaacccggggtaaccgtaaccccgggtaaaccttacccgggaccgtaaacggttaaaccggtaaaccgttaaaaccccgggtaacggtacccggggttaaccggtacccgtacccggttaacccgtaaccgtaacggttacccgtttaccggtttaccctttaaaccccgg

SEQ ID NO: 174895 - DNA, 771 bp, Homo sapiens
  misc_feature: GYAE6OF01BJ6UA.21.33.C11.1.454.CMB.1.raw
tcagtcgtcgctcgcacgaccggtgctcgatttagagtgagctcgttgggtttggggggagaagagctgctcagtcaggacccagagggaaccatcggaaaccccagcgcagcttctccttcctcctgctactctggctcccagaaaccacggagagattgtgttgacgcagtctccaggcaccctgtcttgtctccgaggggacagacgcccaccctctccgtggaccggggccagtacaaagttcgttacccgacgtaccttacttacgccgtacggtaccacgccaacgtaaacccgtcgggacccacgggtcctacccgagtacccttccctaccgactaccccaacgtaaatttaactttactttacccgtaacggaccggggcccggtaccggggcctaaccgtcccccgaaggtaccgtacgggtttccgaagggttcggaccgtaagggttcggggtacgtaggggaacacggttaactttccgaaccttccctacccaacgtactacgacgccgtaacgaccgtggtacgtaccgtagtaacgttacgtttacgaacgtaagttacgttactttaaccgtgttaaccgtacgtaacttaacttaactccgtaaccctaccccgtaacccccgtacgtacccgtaacccgttcccggaacccgtaacgggaacctaccgtaccgtacgtaccgacggtaacgaaccggtaaacgtacgcggttaccggataccgtaccgtaactacgtccttcgttcgttacc

SEQ ID NO: 174896 - DNA, 743 bp, Homo sapiens
  misc_feature: GYAE6OF01EA452.21.33.C11.1.454.CMB.1.raw
  modified_base (731)..(731): a, c, t, g, unknown or other
  misc_feature (731)..(731): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctaccagaaaccaccggagagattgtgttgacgcagtctcaggcaccgtgtcttgtctccgagggacagcgacctcctctcgtcggcgggcacgtataaagttcgtacccgcgtactacgttacgccgtgtaccagtcaacgaaccgtcgaccgacggtctcccgaagtacctcctacactaccaactaacttatacttaccaacgacgggccgacggcacgtaccaaggtaccaggtttaccaggtcgggaacctagggttcggtaccggtagggtaaccgaacggtaccctttaccgaacctttacccgtaccgaacccgtacgtaacgacggtaccctaagcccgggttagggaaccgtaccgttaaggtaacgttacgtttgaacctaagtttactttaacgttaccgttagttaccgaaagtttactaaagttcggtacctactaacccccccgtaaccccgtaaccttacccgtaacccgttacggaacccggttaaagggacccttaaccggacgttacgaaccgtaaggtaaccgtaacgtaaaaccggtcgtacggtccaacgtccgtaacaccgttatccggtttntccgtttacccg

SEQ ID NO: 174897 - DNA, 629 bp, Homo sapiens
  misc_feature: GYAE6OF01EJMM5.21.33.C11.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgccaccctctccgtggccggggccagtacaaacttcggtacccgcgtactacttacgcctaggtaccagcaagaaacctggaccaggcctccagactcctcactccacaatatattcacagggccgcgggcacgtcccagacaggttcaggtcgactaggtcgggtctagggacagtacttcactctacaccatcagcagactcggagaccgtgtaagtntttagactaagttgtatttactgtcgtaagactaatacgtctccgtacccgaacccccgtataccgtaaccgttaccggacccgtaacgggaacctaccggtaacgtacgtaccgaaggtaacgtaaacggtaaacggtaacggtcgggtacggacggttaccgtacccaaccctagttaccttacgttccttaacccg

SEQ ID NO: 174898 - DNA, 778 bp, Homo sapiens
  misc_feature: GYAE6OF01EQ2O3.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccacggagagattgtgttgacgcagtctccaggcaccctgttctttgtctccgaggggcagacgccctacctctcctggccggggccagtactaaattcgtacccgcgtacctacttacgcctcggtaaccagacaacggtaaaccgtcggacccaggaccctcccgacgtacctcctcactaccccaactaaagtattacttccgtacgtacggggccgccgggaccactacccgagacgtacggttcgagtcggactagggttcggtacggtacgggacgtaacggtaccctttacctaccgttacctaccgaaacccgtacgttaccaaggtaccgtaacgggtaccgtacggggtaaccggtacccgtttaaggggtaaagtttagtttttaacgaactaaacgtttagtttaacttttaccggtacggtttaaccgaacggttaacttaagttacgttaccgtaccccgttacccccgtaacccccgttaacgttaccccgttaacccggttaacccgggtaaccgaaccgggacccgtaacggtacctacggtaccgtagaacgtacggaaaacgttcggtacgtcggtactacgcctaacgtactcgtttaccgtccgttaaccc

SEQ ID NO: 174899 - DNA, 813 bp, Homo sapiens
  misc_feature: GYAE6OF01DPR9J.21.33.C11.1.454.CMB.1.raw
tcagtcgtcgctcgcacgaccggtgctcgatttagagtgagctcgttgggttggggggagaagagctgctcagtcaggacccagagggaaccatggaaaccccagcgcagcttctcttcctcctgctactctggcctcccaagaaaccaccggagagattgtgttgacgcagtctcaggcaccctgtctttgtctcgagggacagacgccaccctctccgtgcggggccagtacaattcgttaccgacgtacttacgttacgccgtaggtaccagaccacgtaaaccgtcggaccacggtcctacccgaagacctccgtacaactacccaactaaacgttattacttacctacggacggggcccgaccgggactacgttaccccgaaggtaacgtacggttacaagggtcggacgtaggttacggggtacgttacggggaccgtaaggtaaccttaccgaccgttcccgtaccctaacccgtaacgttacccgaacggtaccgtaacgggtaccggttacgggtaacccggttaccccgttaaggtaaaacggtttacgtttttacggaaccgttaaagtttcgtttaaacgttttacgttaaccgttacggtaacgttaaccgtaaatttacgtaccggtaccttaacccccgtacccccgtaaccgttacccgtaacccggtttaccggaacccggttaaaccgggaccgtaacccgttaactacggaccctaaggtaacgtaaacgggaaactacggtcggtacggtacgtacggtacctaacgtactttaccggtcttaccgttacccg

SEQ ID NO: 174900 - DNA, 898 bp, Homo sapiens
  misc_feature: GYAE6OF01DWPV9.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctcccaagaaaccaccggagagattgtgttgacgcagtctccaggcacctgtctttgctccgaggggacagacgccaccctctccgtggccggggccagtacaaagttcgtacccgcgtactacttagcctagtaccagcaacgaaaccgtcgaccgacggccttaccagtacctcctacacgtaccaactaattactacttaccgtacgacggggtccgacggcaccgtaccagaccgtaggtcaggtcggacgtacggtcgggtacgtacggggactacggtacctttaccgaccttacccgtaccgaaccctagtaccgacggtacctaacgggtaaccggttacgggaacgtacccgttaaggtaaacggtttacgttttacgaaacgttaagttttacggttaacgttttaaccggtacggttaacccgaagttaccgttaaaacgttacgttaccccgtaacccgttaacccccccgtaacccccgggtttaaccgttaaccccggtttacccccgggtttaaccgggaaacccccgggttaaaaccgggggtacccgttaaacccggttaaaaccccggttacgggaaaacccgttaaaaggggttaaacccggttaaaaaccggggtaaaaaaccccgggttacggtttacccgggggtaacccgggtttaaccgtaacccccgggtaaacccctttaaaccccggttaacggtttcccggttttaacccgggtttacccttttaaacccccggg

SEQ ID NO: 174901 - DNA, 750 bp, Homo sapiens
  misc_feature: GYAE6OF01AJYU7.21.33.C11.1.454.CMB.1.raw
  modified_base (328)..(328): a, c, t, g, unknown or other
  misc_feature (328)..(328): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcctttcctcctgctactctggcctcccaagaaacccaccggagagattgtgttcgacgcagtctccaggcctacctgttctttgtctccgaggggacagcgcccaccctctccgtcggccgggcctacggtacaaagtttcgtaccccgcgtacttacgttacgcctaggtaccagacacgaaaccgtggaccacggcctacccgacgtaccnccgtacaaccgtccaactaaacttacttacgtacctacggaccggggtacccgngggacctacgacccgacggaactacgggttcgaacggtcggtaccgtagggtttcggtaccgtgggaacctaggtaccctttactacgtccctaccacgtaactccgtaagaccgaacgtcgttaacggggacctaccgggtaacgtaaggtttacctttaggaacctaagtttaggttaacttcgtacgtaacgacgtacttaaagtacgttacccgaccctaccccgtaaccccgtagtacccctaaccggttccgaaccggtaacggtaccctaacggactacggaccgtaaacggtaacgtacccggaaaagtctacggaccgtacgtaccgactaccctaaggttccgtcgttaaccgttccg

SEQ ID NO: 174902 - DNA, 734 bp, Homo sapiens
  misc_feature: GYAE6OF01CRBHG.21.33.C11.1.454.CMB.1.raw
  modified_base (177)..(177): a, c, t, g, unknown or other
  misc_feature (177)..(177): n is a, c, g, or t
  modified_base (224)..(224): a, c, t, g, unknown or other
  misc_feature (224)..(224): n is a, c, g, or t
tcagtcgtcgctcgcacgaccggtgctcgatttagagtgagctcgttgggtttggggggagaagagctgctcagtcaggacccagagggaaccatcggaaaccccagcgcagcttctcttcctcctgctactctcggctccaagaaaccacggagagattgtgttagacgcagtccnccgaggccaccctgtcttgcctacgagggacagacgccacctctcgnggcgggaccagtactaaagtttcgaacccgcgtaacttacgtacgtccgtagtaccgaagacgaacgaaaaccgtcggaccgaacggacccttacccgaaggtaccctaccttacaacttacccgaactaaacgtaacttactttaccgaaccggtacggggcccgtacggggtacaaccgttacccgaacggtaacgtacggttaccgaagggttcggacgaacggttgggtccgttacgggggaacaacggtaccgttaccgtaacttcgtaaccaacgtaataccggaataccgaagtacgttaacggacgtaccgtaggtaaaggttactttacggtaactaagttacggttaattacctaggttacacgtaacctaagtttacacgtacccgtaacccaaccccggtacttaccgacccgttaacgaccgaacggacaacgtaccagtacgaagtaacgacgtaaacctgtcgtagtaccgtacactaacatactcgtactaccg

SEQ ID NO: 174903 - DNA, 808 bp, Homo sapiens
  misc_feature: GYAE6OF01DX0UO.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaacgaaaccaccggagagtattgtgttgacgcagtctccaggccacccttgttctttgtcctaccgaggggacagacgcccaccctctccgtggccggggacctagtactaaagtttcgttacccgacgtacttacgtacgccgtaggtaccaggacaacgtaaccgtcggaccacggtccctacccaacgtacccttccctacgacctacccaaactaatttacttacttaccgtaacggacggggcccgacgggtaccacctacccgaaggtaccgtaggttaccgagggtcggtacgtagggttcgggtacgtaggggacacgttacccgttcaccttaccacctaaccctaacggtcaacggaccgtaacgtacggtacgggtacgtaccgtttaaggtaacgtttacttttacgaacgttaaagttcgtttaaacgtttacgttccgtacgtaacgtaacttaaagttacgttcccgaacccctttacccccgaacccccgttaccttaccccggttaacccggttaaccgggaaacccggtaaccggaacccgtaacgtaccgacgtaaccgtaagaaaccgtaaccggttaaaccggtacggttacggtacggacgtacccgtaacctaacggttcgttaaccgttcttaccgttacccg

SEQ ID NO: 174904 - DNA, 652 bp, Homo sapiens
  misc_feature: GYAE6OF01ANSOU.21.33.C11.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
tcagtcgtcgctcgcacgaccggtgctcgatttagagtgagctcggttgggtttgggggggagaagagctgctcagtcaggacccagagggaaccatggaaaccccagcgcagcttctcttcctcctgctactctggctcccagaaacccaccggagagattgtgttgacgcagtcctccaggccaccctgtntttcccccgtntccgaggggacagacgcccaccctctccgtggccggggccagtacaaagtttcgttacccgcgtactacgttacgcctaggtaccagcaacgaaacctggccaggcctcccagacctcctcactaccaactaatatacttaccgtaacgacgggcccggacggcactccccagaccgtagttcaggtgcgtaggtgggcgtagggactagtacttcactcctacaccactccagcgaacggacgtacggacgtcctaggtaacgttagtttagacttaattgtaactttaacgtcgtactaagactaactagtaccgccctaccccgaacccccgtattacccgttacccgttaccggaaccgaacgggtaccaaccggtactacgacgaacgacgtaaacgaacgtaacgtggtccgactacgacctacgtattcttcgtacttccg

SEQ ID NO: 174905 - DNA, 810 bp, Homo sapiens
  misc_feature: GYAE6OF01CVR6P.21.33.C11.1.454.CMB.1.raw
tcagtcgtcgctcgcacgaccggtgctcgatttagagtgagctcgttgggtttgggggagaagagctgctcagtcaggacccagagggaaccatggaaacccagcgcagcttctcttcctcctgctactctggctcccacgaaaccaccggagacgatttgtgttgacgcagtctccaggcaccctgtctttgtctccgaggggaccagtagcccacctctccgtgccggggccaggtaccaattcgttacccgacgtactacgttacgcctggtacccaggaccaaggtaaaacctcggaccgtaggtcccttacccaagtacctcccgtacactaccctaactaatactactttaccgaacggacggggtcccgcgggacctacgtaccccgaaggtaccgtaagggtttaccaggttcggtaaccgtagggtttccgggggttacctacgggggtaacctaacgggtaacccttttccggaaacccctttccttacccgaaacccgaccgtttaccgacggtaaccccgtaaggttaacggtacgggtaccggttacccggttaacgtaaacgggttaacgttttttacgaacgttaagtttacgttaacgtttaacgttacgttaccgtaacggtactaacgtaacgttacgaccttacccgaacccccgttaacttaccctacccgttaccggaacccgtaacgggacgaacccgtacgtacgaccgtacgtaacgtaccggtaaaccgtacggtacgtacgggtcctaacgaccgtaacctacgttacgttcgtactttacccg

SEQ ID NO: 174906 - DNA, 789 bp, Homo sapiens
  misc_feature: GYAE6OF01DVDYO.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctccttcctcctgctactctggcctccagaaccaccggagagattgtgttcgacgcagtctccaggcctaccctgttctttacgtctccgaggggacagacgccaccctctccgtggccgggcctagtacaaacgtttcgttaccccgcgtaactacgttacgccgttgtaccagaccgaacgtaaccgtcggaccctaaggcccttacccgaagtaccttcccctactaaccttcccaaactaacttacgttactttacccgaacgtacggggcccggtaccggactacgttacccgaaggtaccgtaggttacccaggtcggaccgtaggttcggggtcgttacggggaccgtacggttaaccttcctaacgttccctaccggaaccctacggtacacggtaccgtaagtaccggttcgaaccgtccgtagttaaacgttacttttaggaaccgttagtttagttaactttaccgtagttaccgtaacgtaaccttaagttacgtaccgttacccgtacccccgtaaccccggtacgttaccccgtaacccgtttacccgggaaccgtaacgggtacccaaccggtaaccttcgaaaccgtacgtacgtaaaccggaaacgttaccggtggttacgacgactaccgaacctcgttactccgttccttaacccg

SEQ ID NO: 174907 - DNA, 816 bp, Homo sapiens
  misc_feature: GYAE6OF01CKTOW.21.33.C11.1.454.CMB.1.raw
tcagtcgtcgctcgcacgaccggtgctcgatttagagtgagctcgttgggtttggggggagaagagctgctcagtcaggacccagagggaaccatcggaaaccccagcgcagcttctcttcctcctgctactctggcctaccaacgaaccaccggagagattgtgttagacgcacgtctccgacggccaccctgttctttcgtccgtccgaggggacacgacgccacccgtcctccgtcggccgggacctacgtaactaacgtttccggtacccgacgtacttacgtacgccgtacggtaccgagaccaacgaaccgtcggaccgacgcctacccaagcccttacctccaactacctaactaaacttacttacgttaccgtaaccggacgggacccggaccgggactaacccgtaccgtaaacgacgtacggttacgtacggtcggacgtacgggtacggttacggtacgggaaccgtagtacccttacgtacctactaacccgtaccgtacgttacgacggacgtaacgtacggtacgaaccggttacgtaaggttaaagtttcgtttaacgacgttaaacgttagttttacgtttaaccgtagggttaaccaacgttaacctaaacgttcgtaacccgttacccctaacccccgttacccccgttaacttaccccggtaaccccgttaccgggaacccgaaagggtacccctaacggccgtaacggacaaaggttaccgtaaaccgggaacttacggtcggccggtacgaaccgtacccctaggtacccttaccgttgtttacccggttacccg

SEQ ID NO: 174908 - DNA, 610 bp, Homo sapiens
  misc_feature: GYAE6OF01ALEZX.21.33.C11.1.454.CMB.1.raw
  modified_base (154)..(154): a, c, t, g, unknown or other
  misc_feature (154)..(154): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtgagctcgttgggtttggggggagaagagctgctcagtcaggacccagagggaacccatggaaaccccagcgcagcttctcttcctcctgctactctgctcccagaaaccaccgganagattgtgttgacgcagtctccaggccacccttgtctttgtcctcgaggggacagacgccaccctctccgtggccggggccagtcaaattcgttaccccgcgacttacttagcctggtaccagcacgaactggccaggcctccagacctccnactccaactaatatacttcacgaggggtccgcgggtccatacccagacctaggttccaaggtcggcaggtcgggtctaggggacaggtaccttcaactccgtaccaccgtagtccgagaccaagtacgtagggacgtccgtagtaagttactttcgacgttaattcggtaatttaacgtgttaccagtactaatactcgccctacccaacccccgtatacccgtaccgttccgaccgtaacggacaccgtactgaccagacgtacgaaccgtaagtcgaggcctagccactactctgtcttacc

SEQ ID NO: 174909 - DNA, 728 bp, Homo sapiens
  misc_feature: GYAE6OF01DBCJG.21.33.C11.1.454.CMB.1.raw
  modified_base (279)..(279): a, c, t, g, unknown or other
  misc_feature (279)..(279): n is a, c, g, or t
  modified_base (494)..(494): a, c, t, g, unknown or other
  misc_feature (494)..(494): n is a, c, g, or t
  modified_base (698)..(698): a, c, t, g, unknown or other
  misc_feature (698)..(698): n is a, c, g, or t
tcagtcgtcgctcgcacgaccggtgctcgatttagagtgagctcgttggggtttgggggggagaagagctgctcagtcaggacccagagggaaccatcggaaacccagcgcagcttctcttcctcctgctactctggcctacccaagaaaccgaccggagaggtattggtgttcgacgtcagtcctccgaggcctacccgtgttctttgtctccggaggggacagcgccctacctcgtccgtcggccgggacctagtacctaagtttcccggtacccgngaacctttacgttcggacccgttagggaccaacggtaccgaacggtaacccgtcgggacccgacggtcctacccgacgtacccttcctacacctacctaaactaacgttacttaccgttaccggaaccgcggggccgtaccgggccacctaccgtaagacgtacgttacggaggtcgaggtacggttcggtacggtagggaccacgtacgttacnctacgaccactactacgacgacgtagacgtacggacgtacgtagtagttacgtttacgaataacgttagttaacttggttacgtacgcaagttaactcgtaacctccgtaaccccgacccttacgtacccttaccggtaccgaccggaacggtaccaaccgcttagaaaccgtaagacgtaaaccgtaacgagtcggtaccggntaccgtcctaactcgtactcgttctacccg

SEQ ID NO: 174910 - DNA, 867 bp, Homo sapiens
  misc_feature: GYAE6OF01BZ5NT.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccgaggccaccgtgttctttgtcctccgaggggacaggacgtcctaccctctccgtggccggggacctaggtacctaaacgtttcggttaaccccgcgtaaccttacttacggccctaggtaccagacgtaacgaaacccgtcgggaccctacgggtaccctacccgacgtaaccctccctacaacctccccgaaataacttactaacttcccgtaacgacggggcccgacgggtccaacgttccccgaagtacgtacgttcgacggttacggcgttacgggtcggttacggacgggggaactacggtacccgttaccgtacccgttaccgtacctaacctacgtaccgacgtaccgtaacgttaacccgtagggtaaccgtccgttaaacgggtaatttaacggttttacgaacgttaagtttaaccggttaacgttttaaaccgtcggttaaacctaacgggttaacttaaaccggttacgttacccgtaccccgtaccccccgtttaaacccccggacgtttacccccggttaccccgttaacccggggaaacccgtaaacgggacccgtaaccggtaccggtaggacccgtaaacggtaacgggtaaacccggtaaaccgggttaccgtaggtccgggtaacgttacccgacccgtacgtttacctccggtttactaccccgttacccg

SEQ ID NO: 174911 - DNA, 872 bp, Homo sapiens
  misc_feature: GYAE6OF01C2J2C.21.33.C11.1.454.CMB.1.raw
tcagtcgtcgctcgcacgaccggtgctcgatttagagtgagctcgttgggtttgggggggagaagagctgctcagtcaggacccagagggaaccatggaaacccagcgcagcttctcttcctcctgctactctggcctccagaaaccacggagagattgtgtgacgcagtctccaggcacccgtgttcttgtcgtaccgaggggacagacgccacctctcctggcgggccagtactaaagttccgtaccgcgaacttacgtacgccgtaggtaaccagcaacggaaaccgtcggaccgaacggcctacccgaagaccttactaccgaatacctaaactaaatagttaactttaccgaaccggacggggaccggtcgggacctaacgtcccaaaggtaccgacgggtttacgacgggttacggacgtaaacggtttcggggtaacgttaacgggggaacctaacgggtaaacccttttacgaccttaaccctacccgaaccgttaacgtaccgaacggtaaccggaagtaaccgggtaacgggtaaccgtaaccggttacggtaaaagtttaccgttttacggaactaaaagttaccggttaaatttaaccgggttaataccggtaaagtaaccttaaacttacgtaaccggttaccccgttaacccccgaaacccccggttccgtaaacccccgtttccgggtaaaccccggggttaaccgaaaacgggtaccccgaaaggtacccggttaaacggaccgtaaaacggtaacgtaaaaccgggtaaaaacgtaaccggttacgggttaccgtaaccggtttaaccgacccgttaaaaccgttaccgtacttttaccggtactttaaaccccg

SEQ ID NO: 174912 - DNA, 870 bp, Homo sapiens
  misc_feature: GYAE6OF01AUPK5.21.33.C11.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagagtgagctcgttggggtttggggggagaagagctgctcagtcaggaccagagggaaccatggaaaccccagcgcagcttctcttcctcctgctactctggctcccagaaaccaccggagagtagttgtgttgacgcagtctccaggcnccctgtctttgctccgaggggacaggacgccctaccctctccgtggccgggggacctacgtacgtaaaacgtttcggttaccccggcgtaaccgttacgttacgcccgttacggtaaccaggaccgaacggtaaacccgtcgggtacccgacgggtccctaccccgacggtaacccttccgtacctaactaccccgaaactaaactttaacgtttacctttaacccgtaccggaacgggggtccccggtaacggggacccctaaaccggttacccccgaacggtaaccggtaaccgggttacgtaacggtcggggtaccgaaggggtttccggggtaccggtacgggggaaccctacggtttaacccgttaccgtaacccgttaccgtaacccgtaaacccggttactaaccggaacgggacccttaaacgggggtacccgttaacggggaccgttaaccggtaagggttaaaccggttttaggtttacgaacgttaaggtttacgtttaaccgttaagttccggtaacgtacgtaacttagttacgtccgtaaccctacccgaaccccgtatacccgttaccgacgggaaccgaacgtacgtacgcgtacgacgaaaggacgtacgaaacgttcgtacggtaccgtacgccgtaccttaccggatttaccgtcgttcgttaacccg

SEQ ID NO: 174913 - DNA, 729 bp, Homo sapiens
  misc_feature: GYAE6OF01A0E2I.21.33.C11.1.454.CMB.1.raw
  modified_base (149)..(149): a, c, t, g, unknown or other
  misc_feature (149)..(149): n is a, c, g, or t
  modified_base (312)..(312): a, c, t, g, unknown or other
  misc_feature (312)..(312): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccagaaaccnccggagagattgtgttgacgcagtctccaggccaccctgtctttgtctccgaggggtacagacgcccacctctccgtggccggggccagtctaaattcgttacccgcgtactacgtagccgtgtaccagcaagaaccgtggaccaggcctcccaagacctccncgactaccaactaagtatattccgaacgcgggccggcggactactcccgaagcgtaggttcacggtggacgtaggtcgggtacgtaggggaacacggtaccttccaccgttccgtaccaaccgacgttaccgtaacggaccgtaaggtaccgtacggacgtaccgtaggtaacgtttactttacggtactaagtttacgttaacgtttacgtcggtaccgtaacgttactaacgttacttacccggtacccttacccccgtaacccccggtacgttaccccgtaacccggtttacccggaacccgggtaaacggtaacccgaaccgttaccggccgtaaacgaaggttaaccgtaacggtaaaccgtacgtaggtaccgcgttaccgacctacgtaccgttcttccgttcgttaccg

SEQ ID NO: 174914 - DNA, 808 bp, Homo sapiens
  misc_feature: GYAE6OF01EVLPX.21.33.C11.1.454.CMB.1.raw
  modified_base (161)..(161): a, c, t, g, unknown or other
  misc_feature (161)..(161): n is a, c, g, or t
  modified_base (179)..(179): a, c, t, g, unknown or other
  misc_feature (179)..(179): n is a, c, g, or t
  modified_base (206)..(206): a, c, t, g, unknown or other
  misc_feature (206)..(206): n is a, c, g, or t
tcagtcgtcgctcgcacgaccggtgctcgatttagagtgagctcggttggggtttgggggagaagagctgctcagtcaggacccaggagggaaccagtacggaaccccagcgacagccttctcttcctctgctactctggcctaccaacgaaccgacgganagtagttgtagtcgaccngtacgttccacgacggtacctacgttnttcgttcgaccgtacggagggacctacggactaccctaccgtcctccgggtacggccggacctacgtacttaacgttcccgtaaccgctaacgttagtccggtacgtacgtaaccgagtacgaaccgtaccgtacgaccgaccgtaccgtaccgtacctaccgtacctacctacctacgtaactaattacgttaccgttacgtaccggtaccggcccggtaccggtaccgtaaccgtacccgtaacggtacgttacggttacgtacggtaccgggtacggtacgggttacgggttacgggtacggtacgttaaccgttaccgttaccgtccgttaaaaacccgtcctaaccgtacgtacgtaccgtacgtacgtacggtaccggtacgtacgtacgtacgttagttacgtagttaacgttagttaccgttatacgtacgtacgtagtactactaccgtacccgtacccgtaccgtaccgtaccgttaccgtaccggtacgaccgtaccgtacgtacgtacgtacggtacaacggtaccgtaacggtacggttccgtacgtaccgacgtaccgtacgtacgttcctcgttacccgttaacccg

SEQ ID NO: 174915 - DNA, 815 bp, Homo sapiens
  misc_feature: GYAE6OF01ALHM2.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaacccacggagagattgtgttgacgcagtctccaggccaccctgtctttgtctccgaggggacaggacgcccaccctctccgtggccggggcctagtctaaacttcggttaaccccgcgtaacttacttacggccttggtaaccacgccaacgaaacccgtggacccaacgggcctacccgacgtacctcctaccactacccgaactaaatacttaacttaccgtaaccgacggggcccggaccgggtactaccgtaccccgtaaggtaaccgtacggttaccgaagggttccggacgtaacgggttcggggttaccggttacgggggaacccttacgggtacctttacccgaaccgttaccctacccgaaacccgtaccttaccgaacgtaccgtaaccgggtaaccgtacggggtaaccgtaccgttaagggtaaacgttacgttttaacgaaccgtttaaagttacggttaactttaacgtcgttaacgtaaggtactaacgtacttccggacccttaccccgtaacccccgtacgtacccgtaacccgttccggaacccgaacgggtacctaaccggtacgtcgaaccgtaaggtaaccgtaaggtaaacccgtaaggttcggtacggaccgttacgacccgtactaacgttccttcgttcccgttacc

SEQ ID NO: 174916 - DNA, 827 bp, Homo sapiens
  misc_feature: GYAE6OF01DF294.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaagaaaccaccggagagattgtgttgacgcagtctccaggccaccctgtcttgtctccgagggacagacgccaccctctccgtggccggggccagtacaaagttcgtacccgcgtacttactagcctaggtaccagacaacgaaaccgtcggaccacggcctacccgacgtacctcctacactaccaactaattacttacttacctaaccggacggggtcccggccgggtaccaccgtaccccaaggaaccgtacggttcgaggtcggcgtaggtcgggtcgtacgggactaggtaccttcaaccgtctaaccaccacgtaccaacggacgaacggtaccgtacggggaccgttacccggttaggttaaacgtttacgttttacggaactaaaggttttacgtttaactttcggttaacgtaccgtaaacgtaccgttaaatttaaccgtccgtaacccccgttaacccccgtaaccccccgttaacctttaccccgttaaccccggttacccggggtaaacccgtaaaccggggtaccctaaccgggtacccgtaacgggtaccgtaaacggtaacggtaaaccgggtaaaaccggttaccggttacggggtccgggtaaacccgttacccggtaacccgaacccgttacgttttacccgtttaccgtttcccgtttaaacccgg

SEQ ID NO: 174917 - DNA, 876 bp, Homo sapiens
  misc_feature: GYAE6OF01DZND6.21.33.C11.1.454.CMB.1.raw
  modified_base (809)..(809): a, c, t, g, unknown or other
  misc_feature (809)..(809): n is a, c, g, or t
tcagtcgtcgctcgcacgaccggtgctcgatttagagtgagctcggttggggtttgggggggagaagagctgctcagtcaggacccagagggaaccatcggaaaccccagcgcagcttctcttcctcctgctactctggcctacccaacgaaaccgacggagagtattggtgttgacgctagtctccgaggtcctacccgttgttctttcgtcctccggaggggaccaggaccgtccctacccgttccgtccgtcgggccggggtaccaacgttacgtaaacgtttccggttaccccgacgtaactttaccgttacggtcccgttacggtaaccacgacgaaccgtaaaccgtcggacccacggtccctaccccgagtacccttccctactactaccctaataacttacttacttcgaaccggtacggggcccgaccgggacctaacctaccgtaacgaccggtacggttacgacggttcggcggtagggtcggtacgtagggactacggtacctcacctacttaccaaccgtactacgtacggaaccgtaacgtaccgggtaggtaaccgtccggttaaaggttaacggttttaagtttacggtaaaccgttaagttttaacggtttaaaccgtttcggttaacgttaaccggaaacgtaacggttaaactttaccggtacctacccccgtaacccccgtaacccccgttacgtacccccggttaaccgtacccggggaaacccggtaacggtaacccgaaccggtacgtaccgtaaacggaaccggtttaagaaacccgggttaaanacgggtttcgtaccgggtacctaccggtaacttaacgttaacctttcggcccgtttactttacccgg

SEQ ID NO: 174918 - DNA, 778 bp, Homo sapiens
  misc_feature: GYAE6OF01DGS3H.21.33.C11.1.454.CMB.1.raw
  modified_base (347)..(347): a, c, t, g, unknown or other
  misc_feature (347)..(347): n is a, c, g, or t
  modified_base (767)..(767): a, c, t, g, unknown or other
  misc_feature (767)..(767): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaagaaaccaccggagagattgtgttgacgcagtctccaggccaccctgttctttgtctccgaggggacagagcccaccctctcctggcggggccagtcaaattcgtacccgcgactacgttagcctggtaccagcagaaacctcggaccacggcctacccagtacctcctcactccaactaatatactacgtacgacggggcccgngggaccactccaaggacgtacggttaccgaggttggacgtagggttcggggtacgtagggggaacctaggtaacctttaccgaccttccgtaccccgaacccaacgttcccgaacggtacccgaacggtaccggttacgggacccgttaaccggtaacgggttaaaggtttaaccgtttttacggaaaccttaaaggtttacgtttaacgtttaaccggtttaggtaaccgtaacggtaaccttaaagttaccgttaccggtaccccttaacccccgaccccccgttaacttacccccgttacccggttaccgggaaacccgtaacgggtaaccgaacggtaccgtacgaacctagtaaacggtaaacgaaaccgttaggtcgggttacgtacctacggtacctaaccgtattaccgttnttccttacccg

SEQ ID NO: 174919 - DNA, 751 bp, Homo sapiens
  misc_feature: GYAE6OF01BMF38.21.33.C11.1.454.CMB.1.raw
  modified_base (61)..(61): a, c, t, g, unknown or other
  misc_feature (61)..(61): n is a, c, g, or t
tcagtcgtcgctcgcacgaccggtgctcgatttagagtgagctcgttgggtttgggggganaagagctgctcagtcaggacccagagggaaccatcggaaaccccagcgcagcttctcttcctcctgctactctggcctcccaagaaaccaccggagagattgtgttgacgctagtctccgaggccacccttgttctttgtctccgaggggacagacgccctaccctcctccgtggccggggcctagtactaaagtttccgtacccgacgtaccttacttacgccgtacggtaccagacaacggaaacccgtcggacccgaacggtcctacccgaagtaccttcctacactacccaataatactacttaccgaacgcgggccgacggcacgtacccgagacgtacggttcaggtcggacgtacggttgggtccgtacgggaacctagtacccttcgaccttccgaccctaactacgtccgaacgaccgtaacggtacgtacgggacgtaccgttaaggtaaacgtttcgtttacgaacgtaaagtttacgtttaacttaccgttaggtactaacgtaacgtaattaccggtaccgaccctaacccccgtaaccccgttacgtacccgtaacccggttaccgggaacccgaacggtacccgaacgtaccgtacgaacgtaagaaccgtaaccgtaaacgtacgtcggtaccgtaccgacgtacccgacttattcccgttagtcccgttaccg

SEQ ID NO: 174920 - DNA, 733 bp, Homo sapiens
  misc_feature: GYAE6OF01BIUVH.21.33.C11.1.454.CMB.1.raw
  modified_base (160)..(160): a, c, t, g, unknown or other
  misc_feature (160)..(160): n is a, c, g, or t
  modified_base (259)..(259): a, c, t, g, unknown or other
  misc_feature (259)..(259): n is a, c, g, or t
tcagtcgtcgctcgcacgaccggtgctcgatttagagtgagctcgttgggtttggggggagaagagctgctcagttaggacccagagggaaccatggaaaccccagcgcagcttctcttcctcctgctactctggctcccaggctcagaaaccaccgganaaattgtgttgacgcagtctccaggcaccctgtctttgtctccgagggaagagcccaccctctcctgcagctccagccaagatactccagatctactanatacgcctaggtaccagcaagaacgcccgtggccaggcctcccgaggttccactatcctagtcgcgttcgggtcccagtacgggccacgtcggcaaccgtccgaagtaccgtaggttcgagggtacggcgtaacgggttcggggtacgttcggggaacctaacggttaccttccacgttccgtactacttcctaaacgtttacggactaaacggtacccgttagggtaccgtaccgttaggtaaacgtttacgtttaccggaacttaggtttaacgtttaactttacgtacgttacgtacggtaacgttaaggttagttaacggggttaaccttcccgttaaccccgttcgttacggtttacccggttaccgggaacccggtaaaacggggtacccgtaaagggttaaacggtaaaagtaacccggaaaagtaccggttaggttacggaccgttaacgacccggttaactaacg

SEQ ID NO: 174921 - DNA, 835 bp, Homo sapiens
  misc_feature: GYAE6OF01EWJHA.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgccaccctctccgtggccggggccagtactaaattcgttaccccgcgactacttacgccgtacggtaccagacaacgtaaacctggacccagggccctacccgaagacccttccctacacttaccccaaataaactttacttacgttaccgttaaccggaacggggtcccggacgggtaccaacgttccccgaagtacgtacggttcagggtcggcgtagggtgggtacgtcggggaacaggtacccttacaccttactacccgaacctagttaccgaagccgtaacggtaccggtacgggtaccgtaccgttaaggtaaacggtttacgtttttacgaaccgttaattacggttaacgtttaccgttacggttactaaacggtaacttaaacgttacgttaacggtaccccgttaacccccgtaaccccccgttaaccttaccccggtaacccggtttacccgggaaacccggtaacccgggaaccgtaaccggtaccgtacggtaaccggtaaagtaaccggtaaacgggtaaaacccggttaaccggttcggttacgggtaacccttaccgggtaaccctaaccgttacggtttacccggtttcgttacccgtttaacccgg

SEQ ID NO: 174922 - DNA, 689 bp, Homo sapiens
  misc_feature: GYAE6OF01C6NDB.21.33.C11.1.454.CMB.1.raw
  modified_base (140)..(140): a, c, t, g, unknown or other
  misc_feature (140)..(140): n is a, c, g, or t
  modified_base (417)..(417): a, c, t, g, unknown or other
  misc_feature (417)..(417): n is a, c, g, or t
  modified_base (570)..(570): a, c, t, g, unknown or other
  misc_feature (570)..(570): n is a, c, g, or t
  modified_base (660)..(660): a, c, t, g, unknown or other
  misc_feature (660)..(660): n is a, c, g, or t
  modified_base (679)..(679): a, c, t, g, unknown or other
  misc_feature (679)..(679): n is a, c, g, or t
tcagtcgtcgctcgcacgaccggtgctcgatttagagtgagctcgttggggtttggggggagaagagctgctcagtcaggacccagagggaaccatcggaaaccccagcgcagcttctcttcctcctgctactctggccncccaagaaccaccggagagattgtgttgacgtcagtctccacggccacccgttgttctttacgtcctccggaggggacagacgcccaccctctccgcggccgggccagtacctaaagttccgtacccgcgtacttacgttacgcctagacccagacaacggaaccctgggaccaacggtccctcccgaacgtacctccctacaacctccctaagaactttacttactaccgtaacggccggggcccggaccgggactaccgtacccgaggtaaccgnggttacaggtcggactagggttcgggtcgtaggacacgtacttacgacttccgacctacgatccgtaagccaagactagggacgtaccgtaagtagttatttagacttaagttcgttacttagttacgacagtactaactactccgtaacccnccccaacccgttacctcccgttaaccgcccggtaacccgaacggaccaacgtacgtagacctaggacgtaacgaacggtacgtgacggtntaccgactactacgtttcncgttgtaccc

SEQ ID NO: 174923 - DNA, 649 bp, Homo sapiens
  misc_feature: GYAE6OF01DYKDY.21.33.C11.1.454.CMB.1.raw
  modified_base (433)..(433): a, c, t, g, unknown or other
  misc_feature (433)..(433): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggcctcccaagaaaccaccggagagattgtgttgacgcagtctccaggcaccatgtctttgtcctccgaggggacagacgcccaccctctcctggccggggccagtacaaattcgtacccgcgaactactagcctggtaaccagcaacgtaaaccgtggaccacggcctaccagacctccacactccaactaatatacttctacgacgggccgcggcacgtcccaagacgaggtcgagtcggcgtaggtcgggtctagggactagtaccttcactctaccaccatcagcagactggacncgtagtagttatttacgactattacgttattacgtgtactagtactaattacgtcgacctaccccgaacccccgtatacccgtacccgttaccggaacccgaacggggtaaccccaaccggtaccgtacggaaccgtaacggtaaacgttaacggaaaaccggtacggtagggttaccggaccgtacgaacctaccctacgttccttcggttaccc

SEQ ID NO: 174924 - DNA, 931 bp, Homo sapiens
  misc_feature: GYAE6OF01AI77I.21.33.C11.1.454.CMB.1.raw
  modified_base (262)..(262): a, c, t, g, unknown or other
  misc_feature (262)..(262): n is a, c, g, or t
  modified_base (558)..(558): a, c, t, g, unknown or other
  misc_feature (558)..(558): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctcccagaaacccaccggagagattgtgttgacgcagtctccagcctacctgtctttgtctccgagggacagacgccaccctctacccgtggcggggcctagtactaaacgtttcgttaaccccggngtaaccttaccgttacggcccgttacggggttaacccaaggtccaaaccgtaaaacccgttcggaccccgaaggtccccttaccccgaggtacccttacccgtacacttaacccctaactaaaagtttaccttaacttacgtaaaccggcggggtacccggaccggggtacctaaccgttacccccggaaggtaccgttaaacgggttttccgaaggtacgggacctaacgggggttacgggtccgtaagggggtaccgtaacggtacctttccgaacttaccgtaccctaaaccncggtaccaacgggcctaacggtaccgtgggtaacccgtccgttaaggtaaacgtttaccgttttacgaaccgttaaagttcgttaacggtttacctagttaccgaacgtaactaaacgtacgtttacccgtaccccgttaacccaaccccccggtttaactaccccgttaacccggtttacccgggaacccggtaaaaccgggtacccgtaacccggttaccggaccgtaaaacccgtaaccgggttaaacgtaaaccggggtaaaccccggtaaacggttcccgggttaacggtaacccgttaacccgggtaaaacccgttacccgttaaaccgttacgggtttttccccgttaaccggttttaaacccccg

SEQ ID NO: 174925 - DNA, 785 bp, Homo sapiens
  misc_feature: GYAE6OF01C1XBN.21.33.C11.1.454.CMB.1.raw
  modified_base (185)..(185): a, c, t, g, unknown or other
  misc_feature (185)..(185): n is a, c, g, or t
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggcctacccaacgaaaccgaccggagagtattgtgttggacgcacgtccnccgacggtccacccgtgttctttcgtcctccggagggacagacgccctaccctcgtccgtggccgggctagtactaagtttcgtacccgcgtactacgtacgccgtaggtaccagacaacgtaaccgtcggaccgacgccctacccgacgtacctccgtactacctacctaaactaatttacttacgttaccgaccgggaccggggtcccggaccgggacctaaccttacccgaacggtaaccgttacggttacgacggtacggtaccggtgggttacgggtcggtacgggtaacctacgtacccttcccgtaacgttccctaccgaaccgtacgtaccgacggtaccgaacggtaccgtacggaccgtaccgtaagtaacgtttagtttacgaagttaagttcgttaacgttacgttgtaccgtagtaacttacgtacgttcccgtaccccgtcccgttaacccccgtacgttacccgtacccgttacggaaccggtaaccggtactaaccgtacgtacaaccggagtaaccgtaaacggtaactcggttcggtacgtaccgacgtacccgtacttacttcgttacgtcccgttaaccg

SEQ ID NO: 174926 - DNA, 693 bp, Homo sapiens
  misc_feature: GYAE6OF01EVUA7.21.33.C11.1.454.CMB.1.raw
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
tcagtcgtcgctcgcacgaccggtgctcgatttagagtgagctcgttggggtttgggggggagaagagctgctcagtcaggacccaggagggaaccatcggaaaccccagcgcagcttctcttcctctgctactctggctcccagaaaccacggagagattgtgttgacgcagtctccgaggccaccgtgttctttgtcctacgaggggacagacgcccacctctccgtaggccggggcctagttactaaacgtttcggtaccccgcgtaccttaacgttacgccttaggtaccagacaaccgaaaccgtcggaccgaacggtcctaccagtacctcctacactaccaactaatatacttcgacgacgggccncggcacgtccaagtacgtagttcaggtggacgtaggttcggtacggtgggactagtacctttccacgttcctacgactactgtaacncgtagacgtcggacgtactaggtaacgtttactttagacgttagttacgttaacgtttactagtacgaagttacctaaatttacgtccgacccttaaccccaccccgttactacccggttacccgtaccgggaacttaaccgggactaaccggcctaggtaccaacggtaacgtaacgaaacgggtcttcgggtcgactacggtacccagtttacctcggttacttccgtacc

SEQ ID NO: 174927 - DNA, 646 bp, Homo sapiens
  misc_feature: GYAE6OF01ETAYB.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctacccagaaaccacggagagattgtgtgacgcagtctccaggcaccctgtctttggtctccgaggggacagacgcccaccctctccgtcggccggggacctagtactaaacgtttcgtaccccgcgaacttacttagcctggtaaccagacgagaaacctggaccaggcctccagccttcctcaactccacaatactattaccagacgggccgcgggccagtcccagacgtaggttcaaggtgctaggtcggtctggggacacgtacgttaccagttcctaccaccactcgaagtcgacgtacgtagggacgtccgtaaggtaacgttagttttacgctaacgttaagttaacgtttaactcgtcgagaactaagttactcgctacccgacccgttactaccgtaccgtcccggaacgacggtaacccgacggtccgtacgacctaagactacggaaactacggtcggacgtaccgtcgaaccgtacctatttcttacgtccgttaaccc

SEQ ID NO: 174928 - DNA, 694 bp, Homo sapiens
  misc_feature: GYAE6OF01E3NM4.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctctgctactctggctcccagaaaccaccggagagattgtgttgacgcagtctccaggcaccctgttctttgtctccgaggggacagacgcccaccctctccgtggcggggccagtcaagtttcgtaccccgcgtaacttacttacgccgtaggtaccaggacaacgaaaccgtcggaccacggcctcccagacctcctacactaccaacaattatacttactacggacgggtcccggacgggtccactccccgaagaccgtaggttcaagggtcggacgtaggttacgggtcgtaggggtaaccaggtacccttccgacgtcctaccgaaccctaagtccgaaacgtctaacgggtaccgtacgggaacgtccgtaagtaacggttattttacggactaagtttagttaactttactggttacgaacgtactaaagtacgtacgtccctaccccgaacccccgtatacccgttaaccgttcccggaaccgaacgggaccaacgtacctaggaccagtaacgaacgtaaacgacgtggtacgacgtccgacctactatcgttcgttccttaccg

SEQ ID NO: 174929 - DNA, 764 bp, Homo sapiens
  misc_feature: GYAE6OF01ESOH9.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctcaggcaccctgtcttgtctccaggggacagacgcccaccctctccgtgcggggccagtcaaattcgttacccgcgactacttagccgtgtaccagcaagaaacctggccacggctcccagacctcctcactaccaacaatactatttacctacgacgggtcccgacggggccactaccccaagtacctaggttccaggttcgccgtaggtcgggtctaggggactacggtacctttacgaaccttcgtaccacctattaccgagtaccaagggtacctggggtacctccgttaagtaaacgttgttttacggaactaagtttacgttaactttaccttggtactaagtacctaaagttacgtccggtacctaacccccggaaccccccggttaataccccgttaacccggtttaccggaacccggttaaacggggaaccctaaccggtaccgtaccgtaaccggtaacggtaaacgttaaacccgggaaaaccggttacccggttacgggttaaccgggtacccttaccgggaacccccttaaacccggttaactttaccccgggtttacgtttaccccttaaccccgg

SEQ ID NO: 174930 - DNA, 645 bp, Homo sapiens
  misc_feature: GYAE6OF01BLBI6.21.33.C11.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgctccgaggggcagagccaccctctcctgcggggccagtcaaattgtacccgcgactacttagcctggtaccagcagaaacctggccaggctccagactcctacataccanaatatacttcctacgacggggtccgcgggcacgtcccgagacaggttcagtcggcaggtgggtctaggggacagtacttcgatctcaccgatacgagcagtacgtggacgccgtagtaacgtagttttgactaagttacgttattacgtgtactacgacctaagttactacgtaccctacccgtaaccccccgtatacccgtaacccgtttcccgggaacccgaacggggaaccctaaccggtacgttacggaccgtaacggtaacgttaacggaaaaccggtacggttacggttcgggaccgttacggaccctaaccgtattccgtttcgttccgtttaaccg

SEQ ID NO: 174931 - DNA, 778 bp, Homo sapiens
  misc_feature: GYAE6OF01B3OBT.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgcccaccctctcctggccggggccagtcaaagttcgttacccgcgtacttactacgcctcggtaccagccaacgaaaccgtcgggacccacggccctaccccgacgtacctccctaccactaccaactaattaacttacttaccgtaacggacggggcccgcgggaccactacccgaagaccgtaggttacgtacggtcggacgtagggttcggggtacgtacgggggaacctaggttaccctttacaccgttcctaccaaccctacgtaccaaggcctaaggacgtacgggaacgtccgtaaggttaacgtttaagttttacgaaccgttaaagtttaggtttaacgtttacgttacgtaccgtaacgttaactaaacgttactaccgtaacccgtaccccctaacccccggttacttacccgttaaccccggttaccgggtaaccgaaccggggtaaccaaccggtaccgtacggtacgtaacggtaacgtaacgggtaaacgtaccggtacggtaccggaccgttaccggacctacctacgttacccgttcgttcccgttaacg

SEQ ID NO: 174932 - DNA, 777 bp, Homo sapiens
  misc_feature: GYAE6OF01EYVWL.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacaggacgcccaccctctccgtggccggggccagtactaaactttcggttaccccgcgtaaccttacgttacgccgttacggtaaccagacaacggaaacccgtggacccaggtccctacccagtaccttcccgtacactacccaactaatacttacttacgtacgacgggcccgacggcacgtccccagactaggttcaggtcggacgtacggtcgggtacgtaggggactacgggtacctttacccgacttaccgtaccaacccgtagtaccgacggtaccgtacgtaaccgtacgggacgtacccgttaaggtaacggttatttacgacttaacgttagttaactttacgtacggtacaacgtactaagtacgttccgacccgttacccgaaccccccgtacgtaccccgttaacccggttaccggaacccggtaaccgggtaacccgtaaccggtaccgttaccggaccgtaaacgggtaacgttaacccggaaaacggtaaccggttacgggtacggtaccgtaccgtacccgtaccttaacgttccgttaccggtttaccttacccg

SEQ ID NO: 174933 - DNA, 728 bp, Homo sapiens
  misc_feature: GYAE6OF01BX20R.21.33.C11.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaaccacggagagattgtgttgacgcagtctcgaggcacctgtcttgcctccgaggggacngacgccctaccctctccgtggccggggcagtactaaagttcgttacccgacgtacttacgtacgccgtggtaaccagacaacgaaaccgtcggaccacggcctacccgacgtacctccgtactacctacaactaacttagtacttaccgacggacggtccggaccgggactaccgtacccgaacgacgtacggttacgacgggttacggacgtaacggtgggtccgtaggggactagtacctcgtactcgtaccacactcgacgtacgagacgtacggacgtaccggttagtaaacgtttacgttacgaacgttaaagtttattaacgtttacgttacgtaaccgaagtaactaaacgttcggtaccctacccgtaccccgtaaccccgtctacccgttaaccggacccgtaaccggaaaccggtaccaacggtaccacggtaacgaacggtaacgtaaccggtaaaacgtcggaacggttaccggaccttcgaaccctacgtacgttcgtcgtttaccttaccgg

SEQ ID NO: 174934 - DNA, 745 bp, Homo sapiens
  misc_feature: GYAE6OF01DXG66.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaagaaaccacggagagattgtgttgacgcagtctccaggccacccgttgttctttgtcctccgaggggacaggacgcccaccctctccgtggccgggaccagtactaaattcgtacccgcgtacttactacgccgtaggtaccagacaacgaaaccgtggacccacggccctacccgacgtacctcctctaactacccaacaaattacttactttaccgaaccggacggggccccggacggtacccaccgtaccccgaaggaaccgtacggttaccgaagggtcggacgtagggtcggggtacgtacggggaaacctacggtaacccttaccgacttacctaccaacccgtaacgtaccgaacggtccgaagtaaccggtacgggacgtacccgtaggtaacgtttaatttacggacttaagttacgttacttacgttacgtaacgagtaactaagtttacacgtacccaaccccgtaaccccgtaccgtacccgtacccgttaccggaaccgtaacggacctaaccgtacacgacgaagtaacgaacggtaaacgacggttcggtacggactaccgacctacgactttccggtctccgttacc

SEQ ID NO: 174935 - DNA, 838 bp, Homo sapiens
  misc_feature: GYAE6OF01D6F5V.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcacctgtctttgtctccgagggacaggacgcccaccctctccgtgcggggccagtactaaattcgtacccgcgtactacttacgccgtaggaccagcaagaacgcctggccacggctacccaggttcctcgatctactgccgttcggggtcccacgtcggggcccacgtcgggtccaacgtccccaaggtaccgtaagggttccgaaggttcgggaccgtaaggggttcggggtcgtacggggaacctacggtaaccttacccgactttaccctactaaacgttacctaagtttaacggaccgtaacggtaaccggtacgggtaacgggtacccgttaacggtaaacggtttacgttttccgggaaccgtaacgggttttaacgttttaacgtttaaccgtttaccggttacgtaaccggtaacgttaaacgggtttaagtaacggggtttaacgtttaccccgtaacccggttcggttttaaccgggttaccgggttacccggggaacccggttaaacgggggtaacccctaaaaggggttaaaccggtaaaaaggttaaaccggtaaaaacggtacggttaggtaccgggtactaccgggaccctaaacccgtacgttacgtaaccgttttccgttaaccgttccgtttaccccccg

SEQ ID NO: 174936 - DNA, 813 bp, Homo sapiens
  misc_feature: GYAE6OF01CB75W.21.33.C11.1.454.CMB.1.raw
tcagtcgtcgctcgcacgaccggtgctcgatttagagtgagctcgttgggtttgggggagaagagctgctcagtcaggacccagagggaaccatcggaaaccccagcgcagcttctcttcctcctgctactctggctcccagaaaccaccggagagattgtgttgacgcagtctccaggccaccctgtctttgtctccgaggggacagacgcccaccctctccgtggccgggaccaggtacaaagttcgtaacccgcgtaacttacttacgccttaggtaccagacacgtaaacctcggaccaggccttacccgaaggtaccctccctctaacctacctaactaaattacttactttaccgtaaccggacggggtcccgaccggggtactaaccgttaccccgaacggtaaccgttacgggtttaaccacgggttacggaccgttaaggggttcgggtacgtacgggaacgtacggtaccttacgacctttacgaccgtaaccgtaacttaccgaaggtacccgtaacgggtaaccgtacgggaaacccgtacccgtttaagggtaaacgttttaacggttttaacggtaaccgttaaacgtttagtttaaccgtttacgtttaacgtaacgacgttaaccgtaaagtttaccgtccgttacccgttaccccgtaaccccccggttgtaccccgtttacccgttaccgggaacccgaacgggtaccaaccgggtctacggacgtaacgacgtaacggaaccgttacgtcggtacgaccgttcgaaccgtacagttacgtcgttccgttaaccg

SEQ ID NO: 174937 - DNA, 765 bp, Homo sapiens
  misc_feature: GYAE6OF01C3N9J.21.33.C11.1.454.CMB.1.raw
  modified_base (133)..(133): a, c, t, g, unknown or other
  misc_feature (133)..(133): n is a, c, g, or t
  modified_base (156)..(156): a, c, t, g, unknown or other
  misc_feature (156)..(156): n is a, c, g, or t
  modified_base (219)..(219): a, c, t, g, unknown or other
  misc_feature (219)..(219): n is a, c, g, or t
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactcnggcctcccagaaaccaccggtanacgattggtgttgacgcagtctccaggccaccgttgttctttcgtactccggagggggaaacnccgccctacccgtctccgtgcaacgcctccgacgccaagtaactctaccaggactacctactanacgtaccgtccgttcggaaccgngaaccgaggtaccgtcgtaccggaccgtaaggtccctacccgttacggtttcctaccgtactcttacggtcgtaccggttccggtacccgtaagaaccgggtcctaacggtacgggacctaccgtaccgaagtaccggttacggtccgtaaggtcgtaacgtcgggtcgggtacggttacgggacttaaaaccgtctttccgaaaccttcttacgtaacgtactacgttacgaacgtacgacggttacggcgtactacggtagttacctttacgggaccgtaggtttacgtttactaacggttcgaacgtgggtaacctaggttacggttacgttaaccgtccgtaaccgttcgttacgggttaccggttcggaaccgggttacggaaacggtaagggttaaacaacggtaacggaacgttaacgtcggtacgacgttaccgactacggttccttaacg

SEQ ID NO: 174938 - DNA, 716 bp, Homo sapiens
  misc_feature: GYAE6OF01CF0BL.21.33.C11.1.454.CMB.1.raw
  modified_base (254)..(254): a, c, t, g, unknown or other
  misc_feature (254)..(254): n is a, c, g, or t
  modified_base (609)..(609): a, c, t, g, unknown or other
  misc_feature (609)..(609): n is a, c, g, or t
  modified_base (650)..(650): a, c, t, g, unknown or other
  misc_feature (650)..(650): n is a, c, g, or t
  modified_base (698)..(698): a, c, t, g, unknown or other
  misc_feature (698)..(698): n is a, c, g, or t
tcagtcgtcgctcgcacgaccggtgctcgatttagagtgagctcggttggggtttggggggagaaggagctgctcagtcaggacccagagggaaccactacggaaaccccagccgcagccttctccttcctcctgctactcgtggcctccaacgaaaccgaccggaagtaggatttggtgttacgacgacaagtcctaccgaggcctacctgtcttcgacgtaccggaggggaccagacgcccaccctctccgnggtccgggctaacgtactaagtttccgaaccgcgacttacgttacgcctggaccagactacgaaaccgtcgacaggtacctaccacgtaccactacgactacaacgtaatagtactacacgcggcgtcgcactaccagactagtgaagtcgacgtaggtacggtcgtacgggaataccgtacgtactaccctacgttaaccaaccgttagtaacccgtaggaaccgttacgtaaacgacgggtaccaacgttaacgggtaatttaaaccgtttacggaacttaaagtacgttaacgtttacgacgtaacaaggtacctaagttaccgtacgtaccctaacccgaacccgttaccnccggtaacgttaccgacgaacggtacgaccgttagcccganaaacgcgttaaacgaaaattccggtgaaacgtcgaacgtacaaacgtnttaacgtcgtaccttacg

SEQ ID NO: 174939 - DNA, 759 bp, Homo sapiens
  misc_feature: GYAE6OF01BPA03.21.33.C11.1.454.CMB.1.raw
  modified_base (152)..(152): a, c, t, g, unknown or other
  misc_feature (152)..(152): n is a, c, g, or t
tcagtcgtcgctcgcacgaccggtgctcgatttagagtgagctcgttgggtttgggggggagaagagctgctcagtcaggacccagagggaaccatggaaacccagcgcagcttctcttcctcctgctactctggctccagaaaccacgganagtattgtgtgacgcagtctccgaggcctaccctgtctttgtctcgaggggacagacgcccacctctccgtggcgggaccaggtactaaattcgtaccgacgtactacgttagcctagtaccagacaacgaaacctggaccaaggtcctacccgaagacctcctacactaccaactaatactacttacgacggtacgggaccggcgggacctaacgtcccgaacggtaactacggttacaggtacgggactacgggttcgggtactaggggaaccgtacgtaacttacccgtaacgttaccacctaaaccgaacttaccggaacgaccgtaacggacggtacgggtacgtaaccgtaaggtaacgttaagttttacgaacgttaaagttacgtttaacgttaacgtacgtacgtaacggtaacttaagtacgtaccgtaccctaaccccgtaacccccgtatcccgttaaccccggtcggtaaacccggaacgggacctaaccggtaccagacgtaacgtaaacgtaacggaaaagtaaccgttagggaaccggttccgaaaccgtacccctaaacgtacccggttacttacgttaccttaaccccg

SEQ ID NO: 174940 - DNA, 776 bp, Homo sapiens
  misc_feature: GYAE6OF01DEDMP.21.33.C11.1.454.CMB.1.raw
  modified_base (155)..(155): a, c, t, g, unknown or other
  misc_feature (155)..(155): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaccacggaganattgtgtgacgcagtctcgaggcaccctgtctttgtctccgaggggtacagacgcccacctctccgtggaccggggccagtacaaagtttccgttacccgacgtaacttacgttacgccgtagggtaccaaggaccaacggtaaaacccgtcgggaccaacgggtcccctacccgaacgtacccttaccctcaacctaccccaaataaacttacttaacgtttccgaacggacggggcccggtaccgggactacctacccgtaagaccgtacggttacgaggtcggaccgtaggttcggggtacgtaggggactacggtacttcgacttacaccgaacctaacgtcgacggacgtacgaaaccgttgggaaccgtaccgttaaggaatttacggtttacgaacgttaagttcgttaacttacgttacgtacgacgtaactaaggttactaccgtaccgtaccccgtaacccccggtataccccgttaccggttaccggaaccgggtaacgtaccggactacggttaccgacgtaacgttaaccggaaccggtaaacggtttacgacgggttaccgtactccggtaaaccctacgttacttaccgtcgtttacccgtttacc

SEQ ID NO: 174941 - DNA, 760 bp, Homo sapiens
  misc_feature: GYAE6OF01A61Z7.21.33.C11.1.454.CMB.1.raw
  modified_base (169)..(169): a, c, t, g, unknown or other
  misc_feature (169)..(169): n is a, c, g, or t
  modified_base (717)..(717): a, c, t, g, unknown or other
  misc_feature (717)..(717): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctctgctactctggcctcccaagaaaccacggagagtattgtgttgacgnagtctccgaggcctacctgtctttgtctcgagggacagacgcctaccctcgtccgtggccggggacctaggttactaaacgtttcggtaaccccgtagtaaccttacgttacggtccgttacggtaacccagtaccgaaacgtaaacccggtcggacccgtaaggtaccctacccgtaaggtacccttaccgttacacctaccccgaaactaaacgtacttaccgttaccgtaaccggacggggcccggtacggacccgtacgttacccgaacggtacgtacgggttttccaagggttcggtacgtaaacggtttcggggtaccgtttaggggaaacctaggtcccgtttaaccgtaacggttccctaccgtaaccgtagtcccgtaacgcgaacgtacgtaacggactaccgtaagttaagttactttacggaaccttaagttacgttactacgtcggtacctaagtaccgtagtactccgtactccccgaaccttcgtaccgtccgtacgacgaacgcctacgtacaggcaagtacgcggtaaacncggttaacgcgttacgacaccgtacttagtctgttccctaacg

SEQ ID NO: 174942 - DNA, 785 bp, Homo sapiens
  misc_feature: GYAE6OF01E4BVB.21.33.C11.1.454.CMB.1.raw
  modified_base (411)..(411): a, c, t, g, unknown or other
  misc_feature (411)..(411): n is a, c, g, or t
  modified_base (566)..(566): a, c, t, g, unknown or other
  misc_feature (566)..(566): n is a, c, g, or t
tcagtcgtcgctcgcacgaccggtgctcgatttagagtgagctcgttgggtttggggggagaagagctgctcagtcaggaccaggagggaaccatcggaaacccagcgcagcttctcttcctcctgctactctggcctacccaagaaaccacggagagtattgtgttcggacgcagtcctccgacggcctacctgttctttgtctcgaggggacacgacgccctacctctccgtgggccgggtaccagtactaagtttcgtaccgctaactacgtacgccgtcgtacagacaacgtaaccgtcggccacggcctaccacgacctcctacactaccaacgtaattacttaccgttcgaacggccggggacccggtacgggtccaccgttacccgaagtaccgtacgggttanacgggtcgggacggtacgggtcggggttacggtacgggtaccgagtttacccttcgtaaccttcctaaccaaccgtagtacgacggtaccggtacggtaccggtacggtaccgtaacgtaggttaaacgtttacgttttacaattaaacgttttnttacgttaacgtagttaccgacgtaacgttaattacccgtaccgtaacccctaccccgtaccccgtacttaccccggttaacccggttacccgggaacccggaacgggaacccgtacgggtacctacggaccggtaaacgtaaacgtaaccggaaacggtaccggttcgggaccgacttaccggacccttacgtatttccggttcgttacccttaccgg

SEQ ID NO: 174943 - DNA, 814 bp, Homo sapiens
  misc_feature: GYAE6OF01A1BXI.21.33.C11.1.454.CMB.1.raw
  modified_base (579)..(579): a, c, t, g, unknown or other
  misc_feature (579)..(579): n is a, c, g, or t
  modified_base (747)..(747): a, c, t, g, unknown or other
  misc_feature (747)..(747): n is a, c, g, or t
tcagtcgtcgctcgcacgaccggtgctcgatttagagtgagctcgttgggtttggggggagaagagctgctcagtcaggacccagagggaaccatcggaaacccagcgcagcttctcttcctcctcgctactctggcctaccaacgaaaccaccggagtagtattggtgttcgacgcagttcctaccgaggacctacccgttgttcgtttcgtccgtaccggaaggggactacggtacgccctaacccttccgttaccgtcgggaccgggggacctaacgttaccgttaaaacgtttccggttacccccggtacgtaacgttaaccgtttacggtcccgttaacggtaccgaacgaccgtaaacggaaacccgttcgggacccgtaacgggtcccttacccgaacgtaacccttcctaccaacctacccaaacttaactttaacgttaccgttaccgtaaccggacggggcccggtacgggtacctaaccgtaccccgaaggtacggtacgttacggacgtcggacgtacggttacggtcgtagggtactacgtacgtccttacgtcctaccaccgtancgacgacgtacgaacgtgacccgcgttaagtaaggtttcgtttacgaattacgtttacgtaactttcggtataccgtaatactacgttagtcccgtacccgtaacccgtaccctaccgttacctacccgggttacgaccgtaaacgggtacacggtactggtaaaccncggtaaacgtacgggaaacttcgtacggtacgaccgtactacgtacctggttacttcgttcctaacc

SEQ ID NO: 174944 - DNA, 650 bp, Homo sapiens
  misc_feature: GYAE6OF01CCR66.21.33.C11.1.454.CMB.1.raw
  modified_base (277)..(277): a, c, t, g, unknown or other
  misc_feature (277)..(277): n is a, c, g, or t
tcagtcgtcgctcgcacgaccggtgctcgatttagagtgagctcgttggggtttgggggggagaagagctgctcagtcaggacccagagggaaccatggaaaaccccagcgcagcttctcttcctcctgctactctggcctcccagaaaccaccggagagattgtgttgacgcagtctccaggcaccctgtctttgtctccgaggggacagacgccaccctctcctaggcggggccagtcaaattcgtacccgcgactactagcctggtaccagcanaacctggccaggctcccagacctcctcacgtccaacaatatacttccacaggggccgcgggcactccccagacgacggttgagtcggacaggtcgggtctcggggaacaggtaccgttcactcgtacaccatcagcagacgtgggacgccgtagaagttatttgacgtaatgttaacttacgttacgtacagtactaattatacgtacctacccgtaaccccccgtactaccctacccgttacccgggacccgtaaacgggacctaaccggtacctacggtaccgaacggtaacgttaacggaaaacccgtaacgttcgggacggtacgttaccgacgaacccctacgttacccgttcgtttaccttaacccg

SEQ ID NO: 174945 - DNA, 642 bp, Homo sapiens
  misc_feature: GYAE6OF01ES3WS.21.33.C11.1.454.CMB.1.raw
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacaggacgccaccctctcctggccggggccagtacaaatttcgtacccgcgactacttagcctaggtaccagcaagaacctggaccaggcctacccagacctcctacactccaacaatactattctacgagggcccgaggctactccagacaggttnagtgcgagtgggtcnggacagtctcgactctacaccatcanacgtaagacgtacggacactacggtaaattagtttacgactaagttgttaactttagtcgtacgaagtacctaagttacacgtaccgtaccccgtaacccccgtattacccgttacccggttaaccggaccgaaacgggtaacctccggtaacgaccgacgtaacgtaacgttaacggaaaaccgtaccgttggtacggtccgtaacgaccgtaccgttaagtccgtttcgttccttaaccg

SEQ ID NO: 174946 - DNA, 814 bp, Homo sapiens
  misc_feature: GYAE6OF01D7YO4.21.33.C11.1.454.CMB.1.raw
  modified_base (611)..(611): a, c, t, g, unknown or other
  misc_feature (611)..(611): n is a, c, g, or t
  modified_base (617)..(617): a, c, t, g, unknown or other
  misc_feature (617)..(617): n is a, c, g, or t
  modified_base (654)..(654): a, c, t, g, unknown or other
  misc_feature (654)..(654): n is a, c, g, or t
  modified_base (756)..(756): a, c, t, g, unknown or other
  misc_feature (756)..(756): n is a, c, g, or t
tcagtcgtcgctcgcacgaccggtgctcgatttagagtgagctcgttggggtttgggggggagaagagctgctcagtcaggaccagagggaaccatcggaaacccagcgcagcttctcttcctcctgctactctggcctaccagaaaccaccggagagtatttggtgttcgacgctacgttcctaccgaggtaccctacccgttggtttccttttcggtcctaccggaacgggggaccaggaccgacccctaacccttccgtccgtagggcccgggggtcctaaaggttacctaaaacgtttccggttaaccccgtacgtaccttacgtttacggcccgttcggtaacccgaggttaccaaacggtaaaaccccgttcggggaccctaacgggttacccttaacccccgaggttaacccttcccctaccttaaccttacccctaaacttaacgtttaactttaaccgtttacccgaaccggggaccgggggtccccgtacggggaccccttacctaccccggtaacggtaccgttaagggtttcccaagggttccggacgtaaggggtttccggtagtacgggacctaaggttaccttcaccgttctaccncttaanccgaacgactagtacgtcgggacctacgtagtagttntttacgacttaatgtttactacttcggtactagtactagtaccgtgtaccctcccgaaccgtccgtacgtcccgtacgtacgaggacctcgtaccgacgtanaacggtactaccggaacggtatcgaccggtctacgctacgacttcgtcgtccttaccg

SEQ ID NO: 174947 - DNA, 870 bp, Homo sapiens
  misc_feature: GYAE6OF01DO7I8.21.33.C11.1.454.CMB.1.raw
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
  modified_base (589)..(589): a, c, t, g, unknown or other
  misc_feature (589)..(589): n is a, c, g, or t
  modified_base (824)..(824): a, c, t, g, unknown or other
  misc_feature (824)..(824): n is a, c, g, or t
  modified_base (842)..(842): a, c, t, g, unknown or other
  misc_feature (842)..(842): n is a, c, g, or t
tcagtcgtcgctcgcacgaccggtgctcgatttagagtgagctcggtttgggggtttgggggggagaagagctgctcagtcaggaccaggagggaaccatacggaaacccagcgcagtcttctccttcctcctgctctctcggcctaccaacgaaacccgacggagagttagttggtggttacgaccgactacgttccaccgacggtccctacccgttgtttccttttcggtaccgtaccgggaacgggggactacggacccgtcccctaccccgttccgtacccggtcgggggtacccgggaaccgttaaacgttaaacctttaaaccggttttccggttaaccccgaccgttaaccgttttaacgttacccgggtccggtttacggaaccgaacgtaaccgtaaaccggtaaacccgtccgggaccgtaccgtcccgtaccctacgtaccctcctacctaacctaacctaactaactttactacgttaccgacgggaccgggccgacggtacctacnccggagtcgtacggtanggtcggtacgtggttcgggtagtcgactacgtcttacctactcccactaacgntaccgaggtccgtaacggtcggtacgactttacggggaattaaacttgttacgtattaacgtttagttactcggtaactctaagtaacttagtcctaaccgtaccccgtaccctaacggtccgttaccccgtaccggggtaaaccgaaccggtaacgggtaacgaccgttacggacgtacggtaaaacggtaaaccggttaacgaaacgggtttacggtaccgtccgggttaacnccccgttaaccgttacgnttttacccgggtcttcccgtttaacccc

SEQ ID NO: 174948 - DNA, 793 bp, Homo sapiens
  misc_feature: GYAE6OF01CU2AG.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctcaggcacctgtctttgctccgagggacagacgcccacctctccgtggccggggaccagtactaaacgttcggttacccgcgtaactaccgttacgccgtggtaccagacaacgaaaccgtggccaacggccttacccgacgtaccttcccgtactactaccaactaaactactttaacgttactaacggacgggcccggtaccggggacacgttacccaggactacggttacgaagtcggtacgaggttcgggtcagggtaccaacggtacttaccgacttacctaccgaacctacgtacgacggacgtacgtacgtacgggaccgtaccgtaggaaagttacgttttaacgaacgttaaacgtacgtttaacgtttacgttacggtacgtaacggtaacttaattacgtaccggtaccccttaacccccgtaacccccggtaaccgttaccccgttacccgggttaacccggtaaccggtaacccgggtaccgtaaaccgtaccgtacggaaccgtaacggtaaacggtaacgtaaaccgggtaacggttaccggtacgggtaccgttaccgaacccgtaaccgtaacgttcccgtttacgttcccgttaaaccccg

SEQ ID NO: 174949 - DNA, 906 bp, Homo sapiens
  misc_feature: GYAE6OF01A8I40.21.33.C11.1.454.CMB.1.raw
tcagtcgtcgctcgcacgaccggtgctcgatttagagtgagctcgttgggtttggggggagaagagctgctcagtcaggacccagagggaaccatggaaacccagcgcagcttctctcctctgctactctggcctaccaacgaaaccgacggagagtattggtgttacgacgctagtcctaccgacggacctacccgttgttcgtttcgtccgtaccgggacgggaacacggaccgccctacctcctccggtgggtcgggacctagtaacgtaaacgtttcggtacccgtacgtacttacgtacgtccgtacggtaccagacgaaaccgtaaccggtcggacccgaacggtccctacccgtacgtacccttcctactacctaaccctaaagttaaacttacttaccttaccggaaccggaccgggccggtacggacctaccgtacccgaagtaccgtacggtcgaggtcgacggtagggttcggtacggtacgggactaacggttcctcgtacccttacgtaccaactactaccggaacgacgtaacggtacggtacgggacctaccgtaaggttaacgttttagttacgaactttaaggtttacgtttaaccgtttaacggtacgtaaccgtaagtaactaacgttacgtacccgaacccgtttaaccccccggaaccccgtttacgtaccccggtttaacccggtaacccggtaacgggaaaacccgggttacccgtaaaccggtaccgtacggtaaacccgtaaacgggttaaaaccggtaaaaccgggtaaccgtaaccgggttccgggttaacccgggtaccttaaaaccccgggttccttaaaaccccggtttaccgttttaacccgttttacccgggttaacccttttaaacccccggg

SEQ ID NO: 174950 - DNA, 721 bp, Homo sapiens
  misc_feature: GYAE6OF01EW7R1.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctctgctactctggctcccaagaaaccgacggagagattgtgtgacgcagtctcgaggccacctgttctttgtctcgaggggacaggacgccctacctcctccgtcgggccggggacctagtactaaacgtttcggtacccgcgtaacttactagccgtaggtaccagacaacgtaaaccgtcggaccgacggtccctacccgaacgacccttccctacaccttacccaaacttaacttacgttactttaccgaaccggacggggtcccggacggggtacctaacttaccccgaagtaaccgttacggttacgagggtacggccgtaggtttcggggtacgtacgggacgtacggtcttaccgtctctacgtacgttactagtacgacaacggtacgtacggtacgtacgtagtaacgttcgttaccgtgtaaggttgtttaacttcgtgtacgtagacgtagtacgtagtaacttcctacgtcgttagggtaccgtacggaacgaacggtaactaaggtaacgtaagtaaccgtaaacgttcgtaaggtcggactcggacctaacgtctttcggtacttacttcctcgttcccgtacccg

SEQ ID NO: 174951 - DNA, 742 bp, Homo sapiens
  misc_feature: GYAE6OF01CK5CB.21.33.C11.1.454.CMB.1.raw
  modified_base (249)..(249): a, c, t, g, unknown or other
  misc_feature (249)..(249): n is a, c, g, or t
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacagcgccacctctcctggcgggccagtactaaagttcgtaccgngtactacttacgcctggtaccagacaacgaaacctgggaccacggcctacccagtacctcctacactaccaactaatactacttctaacggacgggcccgcggaccactccgaaggtactacggttacaggtcggctacgggttcgggtcgtagggggaactacggtacctttaccacctttctaccaaccctaagttccgaacggaccgtaacggaaccgttacgggtaccggtaccgttaagtaacggttaacgtttttacggaacttaaagtttgttaactttaacggtacgtacgtaagacctaaattacgtaccgtaccgtaccccgtaacccccgtaacgttaccccgtaacccggttaccgggaaccgaaaccgggtaccaaccggtaccgttacggaccgtaaaggtaaccgtaaacggaaaccggtaacggttcgtaggtaccctacggtaccctaccgtagttcccgttcgttccgtttaccg

SEQ ID NO: 174952 - DNA, 800 bp, Homo sapiens
  misc_feature: GYAE6OF01BON46.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccgagaaaccaccggagagattgtagttgacgcagtctccaggccaccctgttctttgtcctccgaggggacagacgcccaccctctccgtggccggggcctagtactaaagttcgttacccgcgtacctacttacgccttaggaccagacaacgtaaacctcgggtacccacgggcccttaccccgaagtaccctccgtaccactacccaaacttaataccttagttaccgacggacggggtcccgccgggactacgtacccccgagtaaccgtaggttacgaggttcggacgtagggtcgggtcgtaacggggacctaaggttcccttaaccaccgtaccgtaccctaacccgtaatcccgaaggccgtaacggtaccgtagggtaccccgtacgttaggtaaagtttacgtttacaacgttaagttttaccggtttaactttaccggtggaactaacgttaacgtaaactttcggcccccgttaaccgaacccccccgttccccgttaacgtaccccgttacccgggttaacccggaacccggtaacgggacccaaccgtacgaccgtaacgaccgttaacgtaaaccgggaaacttcggtcgggtaccgtacccgtacgaccctaaccgttagttcccgttaacgttcccttacccg

SEQ ID NO: 174953 - DNA, 850 bp, Homo sapiens
  misc_feature: GYAE6OF01ERB85.21.33.C11.1.454.CMB.1.raw
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccgaccggagagattgtgttgacgcagtctcaggcaccctgtctttgtctccgaggggacagacgcccaccctcctcctggccggggccaggtactaaaagttcgttaccccgacgtacttacttacgccttacggtaaccagacgaacgaaacccgttcggaccgacggccctacccgaacgtacctcctacactaccaactaaattaacgtactttaccgtaaccgacggggcccggtaccgggacctacgttacccccgagtaaccgtaggtttacgaggtcgggtaccgtagggtcgggtaccgtaggggaaaccacggttaaccttaccgtaacccttctacccgaaacccaagttacccgaacggtacgtaacgggtaacgtacggggtaaccgtaacccgttaagggtaaacgttttacgttttacgaacgttaaagttgttaaaccgtttaccggttaggtaaccgtacggtaacctaaaagttaccttaccgtaccctaacccccgtaacccccgtacttaaccccgttaccccggttaaccgggtaacccggaaacgggtaaccccgaccggtaaacgttaccgggacgtaaggttaacgtaaaccggtaaaacggtaacccggtttacggacgggtacctaccggtaccgttaacccgttaacgttcccgtttacggtaccctttaacccgg

SEQ ID NO: 174954 - DNA, 919 bp, Homo sapiens
  misc_feature: GYAE6OF01BUI0P.21.33.C11.1.454.CMB.1.raw
tcagtcgtcgctcgcacgaccggtgctcgatttagagtgagctcgttgggtttggggggagaagagctgctcagtcaggacccagagggaacccatggaaaccccagcgacagcttctccttcctcctgctactctggcctccagaaccgacggagagattgtgttgacgcagtctcaggccacctgtctttgtcctacgaggggacacgacgccctaccctctccgtcgggccggggacctagtactaaagtttcgttaccccgcgtaccttacgttacgccttggtaccagaccaacggtaaacccgtcgggacccacgggtccctaccccgaagtacccttaccctaccaaccttaccccaaacttaaacttactttaaccgtttaccgaacccggtacgggggcccccggtacggggtaccctaaccgttacccccgaacggtaccgttacgggttaccaacgggttcggacgtacgggttcgggtccgtacggggaacctacggtaccttaccgaaccttccgtaccctaaccgactaccgaacgtacgtaacgggtaccggtagggaccgtacccgtaagttaacggtttacgttttacggaaccgtttaaagttttacggttaaccgttttaacgttacccggttaacgaaccggttaactttaaaccgttacgtttccccgggtaccccttaccccccgtaaccccccggtttacgttaaccccgggttaaccccggttaccgggaacccccggtaaagggtacccctaaaccggttccgtaaccgggaccttaaaaccgggtaaccgttaaaccgggtaaaaccggttacccggttggggtacccgtacccggttaacccgacccttaacccgggtttaccttacgtttcccggttaccctttaccccgg

SEQ ID NO: 174955 - DNA, 793 bp, Homo sapiens
  misc_feature: GYAE6OF01B01OI.21.33.C11.1.454.CMB.1.raw
  modified_base (741)..(741): a, c, t, g, unknown or other
  misc_feature (741)..(741): n is a, c, g, or t
tcagtcgtcgctcgcacgaccggtgctcgatttagagtgagctcgttgggtttggggggagaagagctgctcagtcaggacccagaggaaccatcggaaaccccagcgcagcttctcttcctcctgctactctggcctcccagaaaccgacggagagtattgtgttagacgcagtctccgaggcctaccctgttctttcgctaccggagggtacacgggacccacccttcgtccgtggccgggacctacgtactaaacgtttccgtacccgacgtaccgttacttacgccgttacggtaccagtaccgaacgtaaacccgtcggacccgtacggtaccctacccgaacgacccttccctacgtacctacccaacgtaacttaacctttacgttaccgtacggaccggggtcccggacgggtacctaccgtacccgagacgtacgggtttcgagggtcggtagtacgggttcggtaccgtcgggaacacgtacgttaccgtactccgtacgtactactcggaacgtaccgtaggtacgtacgggtaacctaccgtaagtaacgtttacgttaccgaattaacggttacgtttaacttaccgtttacgacgtaaacgtcttaaactcggtcccgtacccgttacccccgaacccgtaccttaccggttaaccccggttaccggaaccggttaacgaccgtacgacctacggaacgtacggtaacgtaacggaaccgttacggnggttcccgacgtcgaccgttacgttctacccggttacttccggttcctaccc

SEQ ID NO: 174956 - DNA, 829 bp, Homo sapiens
  misc_feature: GYAE6OF01ESTT3.21.33.C11.1.454.CMB.1.raw
  modified_base (162)..(162): a, c, t, g, unknown or other
  misc_feature (162)..(162): n is a, c, g, or t
  modified_base (190)..(190): a, c, t, g, unknown or other
  misc_feature (190)..(190): n is a, c, g, or t
  modified_base (243)..(243): a, c, t, g, unknown or other
  misc_feature (243)..(243): n is a, c, g, or t
  modified_base (453)..(453): a, c, t, g, unknown or other
  misc_feature (453)..(453): n is a, c, g, or t
  modified_base (527)..(527): a, c, t, g, unknown or other
  misc_feature (527)..(527): n is a, c, g, or t
tcagtcgtcgctcgcacgaccggtgctcgatttagagtgagctcgttgggtttggggggagaagagctgctcagtcaggacccagagggaacccatcggaaaccccagcgcagcttctccttcctctgctactctggcctaccgaacgaaaccgaccggganagtacttgtggttcgaccgcgtagttcnccgaggcctcccttggttctttcgtactccggaagggcacgacgccctcctcnccggtgggccgggctaggtactaacgttccgtacccgcgtacttacgtcgccgtaggtaaccacgacaacggtaaccgtcggacccgacggtccctacccgagtacccttcctacctacgtaaccctaaataacgttcttaccgtttcggaaccggcgggggtcccggcggtacccctaaccgcccggtaagtaccggttcgttaccggngggtaccgcgggttacgggtcgggttaccgtggggaacttaccgttacggttaccctcgttacccggtaaaccnccggtaacgtaccggacgtaacccgtacggtacggtacggtaccgttacggttaagttacggtttacgtttacgtaacggttacttaacggtttacgttacggttacgtaacgtacgtaacgtttactacgtaccccgtcccctaaccccggttaacccttccgttaacccggttacccggtaacccgggacgtaaccggaccgttaccgaacggtaccggaacggtaacgtaaccgtaacgaacggttacgtccggtaccgtcgaccctacgtacctttacgtcccttgttacccctaccg

SEQ ID NO: 174957 - DNA, 878 bp, Homo sapiens
  misc_feature: GYAE6OF01AN841.21.33.C11.1.454.CMB.1.raw
  modified_base (816)..(816): a, c, t, g, unknown or other
  misc_feature (816)..(816): n is a, c, g, or t
tcagtcgtcgctcgcacgaccggtgctcgatttagagtgagctcgttgggtttgggggggagaagagctgctcagtcaggacccagagggaaccatggaaacccccagcgcagcttctcttcctcctgctactctggtcctacccaagaaaccacggagatattcgtgttcgaccgtcgacgtcctccgacggacctacccttgttacctttcgtccgtaccggacggggaccgaggaccgtcccgtaacccttccgtccgttaccggggccggggtacctaacgttaacgtaaccgtttccggtaaccccgtccggtaacctttacgttaccggtaccgttacgggtacccaagtacgtaaccgtaaaccggttcgaccgtacggtacctacccgacgtaccctacctacctacgaaccctaacgtaactaacttacgtttaccgtaaccgaccggggtcccggtacggaccttacccacccggtaggaaccgttacgggttaccgtggtaccgggtaccgtaacggggttcgggtaccgtacggggtaacctaacggttcgttacctaaccgttacccggtccttaaacccacggtttaaccaccggtaacggtaccgttaaccgggtacgggtaacgtaccgggtttaaccgaaaagtttttacgttagttaacccgtaaggtttaaggttaacctaccgggttacgttaacctacggaactaaacgtttaaccgacgtacctaccccggtaacccctcgttaccgtacccgttcggaaacccggtacgtaccgaccggttataccgtaccgngtaaacgaacgtaccgtagtcccggactacgctaacctacgcgttctccggtaacttaccgg

SEQ ID NO: 174958 - DNA, 623 bp, Homo sapiens
  misc_feature: GYAE6OF01CEF8H.21.33.C11.1.454.CMB.1.raw
tcagtcgtcgctcgcacgaccggtgctcgatttagagtgagctcgttgggtttggggggagaagagctgctcagtcaggacccagagggaaccatggaaaaccccagcgcagcttctcttcctcctgctactctggctcccagaaaccaccggagagattgtgttgacgcagtctccaggcacctgtctttgtctcgagggacagcgccacctctcctgcgggccagtcaaattcgtacccgcgtactacttagcctggtaccagcagaaacctggccaggctcccagactcctcactccacaatatattctacgacggccgcggcactccagacaggttcagtggcaggtggtctgggacagtacttcactctcacatcagacgacgacgtggacgtaccgtagtaagtatttacgacgtaagttacggttactttacgttgtacgtaacgtacgtaaattacgtacgtacctaccccgaacccccgtacgtacccgtacccgttaccgggaacccgaaaccgggtaccaaccggtaccgtacgtacgtaacgtaacgtaacggaaacgtaacggtcggtacgtacgtacgacctaacctacttacgtcgttaccgttaccg

SEQ ID NO: 174959 - DNA, 774 bp, Homo sapiens
  misc_feature: GYAE6OF01D8M2B.21.33.C11.1.454.CMB.1.raw
  modified_base (134)..(134): a, c, t, g, unknown or other
  misc_feature (134)..(134): n is a, c, g, or t
  modified_base (405)..(405): a, c, t, g, unknown or other
  misc_feature (405)..(405): n is a, c, g, or t
tcagtcgtcgctcgcacgaccggtgctcgatttagagtgagctcgttggggtttggggggagaagagctgctcagtcaggacccagagggaaccatacggaaaccccagcgcagcttctcttcctcctgctacnctggctccaagaaaccacggagagtattgtgttgacgctagtcctccgaggtccaccttgtctttgctccggagggacagacgacccaccctctccgtcggccgggacctagtactaacgttcgtacccgacgtacctacttacgccgtacggtaccacgacaacgaaaccgtcggaccaggccctacccgataccctcctacactaccaactaactatacttacgacggaccggggccgcggacaccgtaccgaagtacgtacggttacncggtacggtcggtaggtcggggtcgtagggaactcgtaaccgttaccaccgttcctacctaacgtacgtacccgagaccgtaggaaccgtacgggaaccttcgtaagtaacgtttagtttaacgaacttaagtcgtttaacttcgttcactagtacttaagttccacgttacccgacccgtaaccccgttactaacccgttaacccgggacccgggtaaacgtaaaccgggaccctacgggaacctcgggtacccgtaaagtaaaccgttaaaccgggtaaaacggttactacggggttacccgggacttacccgtaaaccccgtaactttaccgggtttacccgttcgttttaaacccggttaccccc

SEQ ID NO: 174960 - DNA, 762 bp, Homo sapiens
  misc_feature: GYAE6OF01A7R0S.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtcctccgaggggacagacgcctaccctctcctgcggggccagtactaaattcgtaccgcgtactacttagcctggtaccagacaagaaacctggaccaggctacccgagtacctcctacactaccaactaatacttacgttacctaccgacgggcccgtacgggcaacgtccccaaggaactagggttaccaggtcggacgtaacggtggggtcctaggggactacggtaccttcgaaccgtctacgacctatacggactacgaaagtaccggtaggtaccgtaccgttaaggtaaagtttaagttttaccgaacgtttaaacgttaggtttaaacctttaacggttaacgttacccgtaaagaccgttaaaacttagttaccgtcccgtaaacccccgttaaccccccggtaactttaccccgtaaaccccgtttaccggggaaacccgttaaaacggggaacccaaaccggtaccggttaacgaccggtaaggtaaacggttaaccgaaaacgtacgttggtacggtaccacgtaccgtaacctacgttacctgttaccttaacccg

SEQ ID NO: 174961 - DNA, 769 bp, Homo sapiens
  misc_feature: GYAE6OF01BU7JU.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctacccaagaaaccaccggagagattgtgttgacgcagtctccaggcctacctgtctttgctccgagggacagacgccctaccctctccgtggccgggccagttaccaaagtttccggtacccgacgtaaccttacgtacgccttacggtaaccagcaacggtaaaccgtcggacccacggtcctacccaacggtacccttcctaccgtaacttaccccaactaaatttacttaacgttaccgtaaccggacggggacccggccgggtacctaaccgttccccgaaggacgttaacggttaccgaagggtcgacggtaacgggttcgggttacgtacggggaactacggtaccgttccaacttccgtacctaaaccgtactaccgtaacgcgtaaacggtacgtacgggaaccgtcgttaaggtaacgttagtttacgaactaaggtttacgttaacttcgtataacgtaagtactaaagttgtacctcccgtaccctaaccccgtactacccgtaccggttaccgaaccgtaacggaccctaacgccgttagaaccgtagtaacgtaaccgtaaaggtcgttacgggcctacgacggtaacccctaattaccgttccttaccggtccttaccc

SEQ ID NO: 174962 - DNA, 668 bp, Homo sapiens
  misc_feature: GYAE6OF01D0IDA.21.33.C11.1.454.CMB.1.raw
  modified_base (166)..(166): a, c, t, g, unknown or other
  misc_feature (166)..(166): n is a, c, g, or t
  modified_base (175)..(175): a, c, t, g, unknown or other
  misc_feature (175)..(175): n is a, c, g, or t
  modified_base (561)..(561): a, c, t, g, unknown or other
  misc_feature (561)..(561): n is a, c, g, or t
  modified_base (612)..(612): a, c, t, g, unknown or other
  misc_feature (612)..(612): n is a, c, g, or t
  modified_base (643)..(643): a, c, t, g, unknown or other
  misc_feature (643)..(643): n is a, c, g, or t
tcagtcgtcgctcgcacgaccggtgctcgatttagagtgagctcgttgggttgggggagaagagctgctcagtcagacccagagggaaccatggaaacccagcgcagcttctcttcctcctgctactctggctcccaagaaccaccggagagattgtgttagacgnagtctccgngccacctgttcttgtctccgagggacagacgccacccgtctcgtacggccggggacctagtacaaacgtttcgtacccgtaccgtactactacggtctacggtaccaacgtacgaacgtaaaccgtcggacccgaggccctaccacggtaccctacctacaactacccaagtaactttatcgttaaccgacgaacgggtccggacggactactacccgaagacgtaggttacgagtcgacgtaggtgggtgaacgggtacacgttaccttacgtaccgtacctccaacgtcctagacgaccgtagtacgtacggcgtaccgtagtaacgtttagttacgtacggttaattacggttacttacgttacgaacgtaggtacaagttanccgtaccgtaccctacccgactaccgtaccgtacgacgtacgactacgtanctacgagacgtaacgtaagcgtacgtgtacncgactacctatcgttactcgtaccg

SEQ ID NO: 174963 - DNA, 718 bp, Homo sapiens
  misc_feature: GYAE6OF01DOPM8.21.33.C11.1.454.CMB.1.raw
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (661)..(661): a, c, t, g, unknown or other
  misc_feature (661)..(661): n is a, c, g, or t
  modified_base (697)..(697): a, c, t, g, unknown or other
  misc_feature (697)..(697): n is a, c, g, or t
tcagtcgtcgctcgcacgaccggtgctcgatttagagtgagctcgttgggtttggggggagaagagctgctcagtcaggacccagagggaaccatggaaaccccagcgcagcttctccttcctcctgctactctggctcccaagaaccacggagagattgtgttcgacgcagtctccaggcctaccctggtctttgtctccgaggggaccagacgccaccctctaccgtggcggggccagtaccaaagtttcgtacccgcgaaccttacgttacgcctacggtaccagaccagtaaaccgcggaccgaccggccttacccgagtacctacccgtacaccttacccaataactacttattaccgacgcggccggacggactaacnccccagtacctcggtacncggtagcgtagggttcgggtacgtacggggtactacggtacctttaccgacgtttaccacgacctacgttacggacttaccggaacgtaccgtacgggaccggtaaccgtgtaaaagttacggttttacaacgtttaaacgttggtttaaccgttacgtttacggtaacctacggacttaaacgttcgtacgtccgtacccctaacccggcttacccgtacccgttacggaccaacggtcgaaccgtccgtgaccgtanacgtaccgaaacgtacggtgaccgtctacggtaccncgtacttctcggtcttacccg

SEQ ID NO: 174964 - DNA, 875 bp, Homo sapiens
  misc_feature: GYAE6OF01DM0QQ.21.33.C11.1.454.CMB.1.raw
tcagtcgtcgctcgcacgaccggtgctcgatttagagtgagctcggttggggtttgggggggagaagagctgctcagtcaggacccagagggaaccatcggaaaccccagcgcagcttctcttcctcctgctctctggcctaccaagaaaccacggagagtattgtgtgacgcagtctccgaggcctaccttgttctttgtcctaccggaggggaccaggaccgccctaccctccgtccgtcgggccggggcctaaggttacctaaacggtttccggttaaccccggacgtaaccttaccgttacggcccgttacggtaacccaggaccgaaacgtaacccgtcgggaccctacggccctcccgagtaccctcctacactaccaataattacttacttccgacgacggggcccggacggtaccaccgtacccgaaggtaccggtacgggttcgacgggtacggccggtaagggttcggggtaccgtacgggggtaactaccggttacccttcctaccgttacccgttacccgaacctacggttcgacgacgacgggtaccgtacgggacgttaccgtaagttaacgtttacgttttacggacttaacgtttacgttacgtttacgtacgtaaccgtaacgtaaccttaaccgtttacgtacccgttacccgttaacccccgtaacccccgtacgttaccccggttaacccggttaacccgggtaaccccggtaaaccgggacccgtaaaccgtcccggtaacgtaaccgtaacggtaaacggtaccggtaaacggttaacggggttcgtaccgggttaacctcccggtaaccttaccgttaacgtttcccgggtttaaccttcccgtttacccgg

SEQ ID NO: 174965 - DNA, 731 bp, Homo sapiens
  misc_feature: GYAE6OF01A3BD2.21.33.C11.1.454.CMB.1.raw
tcagtcgtcgctcgcacgaccggtgctcgatttagagtgagctcgttggggtttgggggggagaagagctgctcagtcaggacccagagggaaccataggaaaccccagcgcagcttctcttcctctgctactctgctcccagaaaccaccggagagattgtgttgacgcagtctccaggcaccttgtctttgtcctcgagggacagacgcccacctctcgcgcgggcagtactaagttcgtacccgctactacttgccgtacggtaccagacgaacgaaccgtggacccgacggcctacccagtaccctccgtactactaccaactaattactacgttactaccggacgggccgcggacaaccgtccgaagacgtaggtcgaggtcggacgacggtgggtcagggacacgtacttcaccttcgacctaccgtaatcggacacgtacgtacgtacgaccgtccggtaaggtacttacgtttacgacttaaaggttactttaacgtttacgtacgtaaccttaagtaactaaacgtcttaacccgtcccttaaccccggaaccccgttacgttaacccggtcccccggttacgggaaaccccgtaaacggggtaccctaaccgttacgaccgtaaagtaacgtaacgttaaaccggaaaacggttcggtaccgggttagtaccccgttacgtcctaaaaccgttccctttacgttaccggtccttaaccccg

SEQ ID NO: 174966 - DNA, 754 bp, Homo sapiens
  misc_feature: GYAE6OF01A54Q9.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctccgtggccggggccagtctaaacttcgtacccgacgtactacttacgccgtggtaccagacaacgaaacctcggaccacggcctacccagacctcctcactacccaacaattactacttccgtaccgacggggtcccgacggggctaaccgtccccgaaggtaccgtacgggttacctagggtcggaccgtaagggtcggtaacgttccgggtacggggaactaacggtaacctttccgtaacttcccgtaccaaccctaacgtaccaacgtccgaacggtccgtacgggtaccgtaccgttaaggtaaacgttacgttttacggactaaagtttagttaactttacgtcgttaccgaagtactaagttacgtcgtcccctaacccgtacccccgtattaccccgtaccggttaaccgggacccgtaacgggtacccgtacggtaccgtacggaacgtacggtaaacgtaacggtaaaccgtcggttacggtacggtaccgttacgaccctaaccgtacttcgttcgttacccg

SEQ ID NO: 174967 - DNA, 847 bp, Homo sapiens
  misc_feature: GYAE6OF01A5HTL.21.33.C11.1.454.CMB.1.raw
  modified_base (573)..(573): a, c, t, g, unknown or other
  misc_feature (573)..(573): n is a, c, g, or t
tcagtcgtcgctcgcacgaccggtgctcgatttagagtgagctcgttgggtttggggggagaagagctgctcagtcaggacccagagggaaccatcggaaaccccagcgcagtcttctcttccctcctgcctactctcggcctacccgaacgaaacccgaccggagagtagttggtgttcgaccgctagtcctaccgaacggcctacccgttgttcctttcggtcctccggaggggacaggaccgccctacctctccgtggccgggacctagtactaacgttccgtacccgagtaccttacgtacgcgtacggtacagacgaacgaacctcggccacggtcccaccgacgtacctccgtactcctaaccaattaactacttacgttaccgaaccggtacgggccggtaccggaccaccttaccccgaaggtcccgttaagttaccgacgggtcgtaccggtacgggttacgggtcgtacgggaactaccgttaccgtacctaccgttccgacctacgtacgaccgaacgtacgtacgtaacggtcggaaccgttacgtaaggttaaacgtttntttacggaacgttaacgttccgtttacgttacgttccgtaaacggaccgtagttaacgtccgtacccaccccgttaccccaaccccggttacgttaacccccgttacccgggttacccggaaacccggttaaaggtacccccgtaaaccggttacgaacccgggtaaaccttaagggttaaaccccgtaacggtaaccggtaacggttaccgggaccggttaccaacccgttacccaagttaaccctttcggttacccttaccctttaccccgg

SEQ ID NO: 174968 - DNA, 501 bp, Homo sapiens
  misc_feature: GYAE6OF02IVDI3.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactctcatccacaatatattctacagggccgcgggcatcccagacaggttcagtggcagtgggtctgggacagacttcactctcaccatcagcagactggagcctgaagattttgcaatgtattactgtcagcaatatgctcaccccgatccaccttcggaccaacggacaacgactgcagatgaaacgaactgtgctgcaccatctgtcttc

SEQ ID NO: 174969 - DNA, 497 bp, Homo sapiens
  misc_feature: GYAE6OF02G7WPH.21.33.C11.1.454.CMB.1.raw
tcagtcgtcgctcgcacgaccggtgctcgatttagagtgagctcgttgggtttggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaacctggccaggctcccagactcctcatccacaatatattctacagggccgcgggcatcccagacaggttcagtggcagtgggtctgggacagacttcactctcaccatcagcagactggagcctgaagatttgcaatgtattactgtcagcaatatgctccaccccgatccaccttcgccaagggacacgactgcagatgaacgacgtgtgctgcaccatctgtcttc

SEQ ID NO: 174970 - DNA, 510 bp, Homo sapiens
  misc_feature: GYAE6OF02HIAOV.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtatttgactaatgtattacttgtcagcaatatgctccacccccgatccaccttcgaccaacgggacacgactgcagatacgaaacgaactgtagctgcaccatctgtcttc

SEQ ID NO: 174971 - DNA, 508 bp, Homo sapiens
  misc_feature: GYAE6OF02GXQTZ.21.33.C11.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccncgggcatcccagacaggttcagtggcagtgggtctgggacagacttcactctcaccatcagcagactggagcctgaagatttgacaatgtattactgtcagcaatatgctcacccccgatcaccttcggccaacgggacacgactcgcagacgtgaaacgacgtgtggctcgacaccatctcgtcttc

SEQ ID NO: 174972 - DNA, 520 bp, Homo sapiens
  misc_feature: GYAE6OF02F7UWM.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctagaagtattttgctaatgtattactgtcagacaatatgctccacccccgataccaccttcggaccaacgggacacgactgacgagacgtagaaacgaactaggtagctgacaccatctcgtcttac

SEQ ID NO: 174973 - DNA, 510 bp, Homo sapiens
  misc_feature: GYAE6OF02G91JX.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagctgaagtatttgctaatgtattacttgtcagcaatatgctccaccccgactccaccttcgaccaacggacacgactcgacagacgtgaaacacgtgtcggctacgcaccatctcgtctc

SEQ ID NO: 174974 - DNA, 505 bp, Homo sapiens
  misc_feature: GYAE6OF02IKXHR.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtattttgcaatgtattactgtcagcaatatgctccacccccgatccaccttcggccaacggacaacgactgcagatagaaacgactgtgctcgcaccatctcgtctc

SEQ ID NO: 174975 - DNA, 504 bp, Homo sapiens
  misc_feature: GYAE6OF02HITAR.21.33.C11.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacatagccaccctctcctgcggggccagtcaaattgttacccgcgactacttagcctggtaccagcagaaacctggccaggctcccagactcctcatccacaatatattctacagggccncgggcatcccagacaggttcagtggcagtgggtctgggacagacttcactctcaccatcagcagactggagcctgaagattttgcaatgtattacttgtcagcaatatgctccacccccgatccaccttcgccaacgggacacgactgcagacgtgaacgactgtagctgcaccatctgtctc

SEQ ID NO: 174976 - DNA, 518 bp, Homo sapiens
  misc_feature: GYAE6OF02GT6XZ.21.33.C11.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagagtgagctcgttgggtttggggagagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgngactacttagcctggtaccagcagaaacctggccaggctcccagactcctcatccacaatatattctacagggccgcgggcatcccagacaggttcagtgcagtgggtctgggacagacttcactctcaccatcagcagactggagctgaagtattttgactaatgtattactgttcagacaatatgcctaccacccccgtatacctaccttcgaccgaacggaccacgactcgacagatagaacgaactagtgactcgacaccatctgtcc

SEQ ID NO: 174977 - DNA, 513 bp, Homo sapiens
  misc_feature: GYAE6OF02H0HSE.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtgcagtgggtctgggacagacttcactctcacatcagcagactggagcctagaagtatttgctaatgtattactgtcagacaatatgctccacccccgatccaccttcggaccaaggaccacgactgcagatagaaacgaactgtagctcgacacctatctcgtcttcc

SEQ ID NO: 174978 - DNA, 554 bp, Homo sapiens
  misc_feature: GYAE6OF02GH0IN.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagattttgactaatgtaattactgtacagactaatatcgcctacccaacccccgtatacctacccgttccggaccgaaacgggaccaacgactacgacaagtacgtaacggaaaccgtacgtaggtacggctacgaccacctatcgttcgtacttacc

SEQ ID NO: 174979 - DNA, 836 bp, Homo sapiens
  misc_feature: GYAE6OF02HD7K9.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcacctgtctttgtctccagggacagagccacctctcctgcgggccagtcaaattcgtacccgcgactacttagcctggtaccagcagaagcctggccaggcctcccaggttcctcatctatgcgtcgggtccccagacgggcccacgtcggaccaacgtccccgaagtaccgacgggtttccaagggtcggaccgtaagggttcggggttcgttacgggggaacctaacggtacctttaccgaaccgttccttaccgtaattaccgtaaagttttaacggaccgtaaacgggtaccgtttacggggaaacgtccccgttaagggtaaaacggttaacgttttaccgggactaaacgggtttacgtttaaacgttttaaccgtttacggttaaccgtaaggtaccgttaaagggtttaacgttaacggggttaaaaccggttttacccgtaacccgtttccggtttaccgggtttacccgggtttacccgggtaacccggtaaaaacgggggtaacccgtaaaagggggttaaaccgtaaaaaggttacgggtaaaaaacccgggtaaacggtttcggtaacggggttaccgttaacggacccgttaacccgttacgttacccgtttcggtttaccctttaccgtaaccgtttcccccg

SEQ ID NO: 174980 - DNA, 509 bp, Homo sapiens
  misc_feature: GYAE6OF02IRNTZ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtgcagtgggtctgggacagacttcactctcaccatcagcagactgagcctagaagtatttgacaatgtattactgtacagcaatatgctccacccccgatccaccttcgaccaagggacacgactgacagatagaaacgactgtcgactcgacaccatctgtctc

SEQ ID NO: 174981 - DNA, 516 bp, Homo sapiens
  misc_feature: GYAE6OF02HZ1C9.21.33.C11.1.454.CMB.1.raw
  modified_base (482)..(482): a, c, t, g, unknown or other
  misc_feature (482)..(482): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggctcccagactcctcatccacaatatattctacagggccgcgggcatcccagacaggttcagtgcagtgggtctgggacagacttcactctcaccatcagcagactggagcctagaagtattttgactaatgtattactgtcagcaatatgctccacccccgatccaccttcgaccaaacgggacaacgactcgacacgagngaaacgaactcgtagctgcaccatctgtcttacg

SEQ ID NO: 174982 - DNA, 520 bp, Homo sapiens
  misc_feature: GYAE6OF02GKVXC.21.33.C11.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtatttgacaatgtattactgtcagcaatatgctccaccccgatctaccttcgaccgaaggacacgacngacagatcgaaacgaactggtaggcctggccacctactcgttacgtcttaccg

SEQ ID NO: 174983 - DNA, 604 bp, Homo sapiens
  misc_feature: GYAE6OF02IO93M.21.33.C11.1.454.CMB.1.raw
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
tcagtcgtcgctcgcacgaccggtgctcgatttagagtgagctcgtttgggggtttgggggagaagagctgctcagtcaggacccagagggaaccatggaaaccccagcgcagcttctcttcctcctgcctactctggctcccgagaaaccaccgggagaggacttgtgttgaccgcagtctccaggcaccctgtctttgtcgtccagggacagagccaccctctcctgcgggccagtcaaattcgtacccgcgactacttagcctggtaccagcagaaacctggccaggctccagactccncatccacatactattcacaggccgnggcatcccagacacggttcaggtggcagtcgggtctgggacagacttcgactctacaccatccagcagactggacgtcctaggaacgtagtttgactaagttggttaacttacgtgttacaacgtactaaatagtcgtaccttacccaacccccgtattacctaccgttaccggaccgtaacgggaccaccgtacgtacgtcgtaagtacgtaacggaaaccggtaacgtggtacgacgttacgacctaccgtacgtccgttacgttaccttacccg

SEQ ID NO: 174984 - DNA, 519 bp, Homo sapiens
  misc_feature: GYAE6OF02HCNTH.21.33.C11.1.454.CMB.1.raw
tcagtcgtcgctcgcacgaccggtgctcgatttagagtgagctcgttgggtttgggggagaagagactgctcagtcaggacccagagggaaccatggaaaccccagcgcagcttctcttcctcctgctactctggctcccagaaaccaccggagagattgtgttgacgcagtctccaggcaccctgtctttgtctccaggggacaggagccaccctctcctgcggggccagtcaaattgttacccgcgactacttagcctggtaccagcagaaacctggccaggctcccagactcctcatccacaatatattctacgagggccgcgggcatcccagacaggttcagtgcagtggtctgggacagacttcgactctcaccatcagcagactggacgctagaagtattttagactaatgtattacttgtacagtacaatatgctaccaccccgtatcaccttcgaccgaacggacacgactgcagacgtagaacgaactgtgcgtcgcaccatctgtctcg

SEQ ID NO: 174985 - DNA, 506 bp, Homo sapiens
  misc_feature: GYAE6OF02HIHX2.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagatttgcaatgtattactgtcagcaatatgctccacccccgtatccaccttcggaccaagggaccacgactgcagatgaaacgactgtgctgcaccatctcgtcttc

SEQ ID NO: 174986 - DNA, 542 bp, Homo sapiens
  misc_feature: GYAE6OF02JDI85.21.33.C11.1.454.CMB.1.raw
  modified_base (302)..(302): a, c, t, g, unknown or other
  misc_feature (302)..(302): n is a, c, g, or t
  modified_base (538)..(538): a, c, t, g, unknown or other
  misc_feature (538)..(538): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggcctccagactcctcatccanaatatattctacagggccgcgggcactcccagacaggttcagtggctaggtgggtctgggacagtacttcactctacaccatcagcagacgtggacgtcctaggaagtatttgactaattacgttattacttgtacagtacaatatcgcctcccaccccgtatcctaccgttcggaccaagggaccacgactgacagacgtaacgaacgtactgtacgctgccacctatcgtcgtntacc

SEQ ID NO: 174987 - DNA, 507 bp, Homo sapiens
  misc_feature: GYAE6OF02JHZXU.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcggcatcccagacaggttcagtgcagtggtctgggacagacttcactctcaccatcagcagactggagctgaagtatttgactaatgtattactgtcagcaatatgctccaccccgatccaccttcgccgaaggacacgactgcagactacgaaacgaacgtgtgctcgcaccatctacgtcttac

SEQ ID NO: 174988 - DNA, 544 bp, Homo sapiens
  misc_feature: GYAE6OF02G2L74.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccagggacagagccacctctcctgcgggccagtcaaattgtaccgcgactacttagcctggtaccagcagaaacctggccaggctcccagactcctcactccacaatatattctacagggccgcggcatcccagacaggttcagtcggcagtgggtctgggacagtacttcgactctacaccatcagcaagactggacgccgtagaagtatttgactaatgtattactagtctagactaatatgctccaccccgtataccaccgttccggaccgaacgggacaaccgactacgactagacgtaacgaacgaacgtgtacgcgtacgacctaccgattacgtcgtcttacg

SEQ ID NO: 174989 - DNA, 529 bp, Homo sapiens
  misc_feature: GYAE6OF02G0UC0.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagattttgactaatgtattacttgtcagcaatatgcctccacccccgataccaccttccggacccaacgggaccacgacctcgcagacgtacgaaaccgaacgtagtaggcgtcgacacctatctgtcttac

SEQ ID NO: 174990 - DNA, 557 bp, Homo sapiens
  misc_feature: GYAE6OF02G3IGP.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgtacccgcgactacttagcctggtaccagcagaaacctggccaggcctcccagactcctcactccacaatatattctacgagggcccgcgggcactcccagacaggttcaggtggcaggtgggtctgggacagcttcactctcaccatcagcagactggacgccgtagaagtatttagactaatgttattacgtgtactagacaatatcgtctcccacccccgtactcctaccgttccggaccgaacgggacaccgactcgacgtacgagtacgaaacgacgtacgtacggacgtacgaccacctactcttacgtcttaac

SEQ ID NO: 174991 - DNA, 588 bp, Homo sapiens
  misc_feature: GYAE6OF02ITJ6T.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattcgtacccgcgactacttagcctggtaccagcagaaacctggccaggctcccagactcctcatccacaatatattctacaggccgcggcatcccagacaggttcagtggcagtgggtctgggacaggtactcgactctcaaccatcacgcagacgtggacgccgtagaacgtattttagactaataggttatttaacgtgttacaggtactaaatatagtctacccacccccgataccgtaccgttccggaccgaaacgggacaaccgtacgtcgacgaagtacgtaacggaaaccgaacgttacgtacggtaccgtcgaccgtaaccgtacttaccgttcgttacctttaccg

SEQ ID NO: 174992 - DNA, 522 bp, Homo sapiens
  misc_feature: GYAE6OF02G8SAI.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctccagactcctcatccacaatatattctacagggccgcgggcatcccagacaggttcagtgcagtggtctgggacagacttcactctcaccatcagcagactggagcctgaagtatttgactaatgtattacttgtcagcaatatgctccacccccgatccaccgttccgaccgaacgggacacgacctcgacagacgtacgaaacgacgtacgtgcgtacgacaccactctcgtcttac

SEQ ID NO: 174993 - DNA, 549 bp, Homo sapiens
  misc_feature: GYAE6OF02IBG2G.21.33.C11.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (428)..(428): a, c, t, g, unknown or other
  misc_feature (428)..(428): n is a, c, g, or t
tcagtcgtcgctcgcacgaccggtgctcgatttagagtgagctcgttgggtttgggggaggaagagctgctcagtcaggacccagagggaaccatggaaaccccagcgcagcttctcttcctcctgctactctggctccagaaaccaccggagagattgtgttgacgcagtctccaggcacctgtctttgctccagggacagagccacctctccngcgggccagtcaaattgtacccgngactacttagcctggtaccagcagaaacctggccaggctcccagactcctcatccacaatataattctaacaggccgcgggcatcccagacaggttcagtgcagtgggtctgggacagacttcactctcaccatcagcagactggagcctgaagattttgacgtaatgtaattactgttcagcaaatanacgcttccaacccccgtatcctaccttccggaccaaagggcaaccgtactcgcctaaggataacggaaactaaacgtcggttagggccttggacctacctaagtccttacggtcctttaac

SEQ ID NO: 174994 - DNA, 547 bp, Homo sapiens
  misc_feature: GYAE6OF02IQ2XP.21.33.C11.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgcggggccagtcaaattgttaccccgngactacttagcctggtaccagcagaaacctggccaggcctcccagactcctcatccaacaatatattctacagggccgcgggcatcccagacaggttcagtggcagtgggtctgggacagacttcactctacacatcagcagactggagcctagaagtattttgcgtagtagttattacttgtcagtatgtatggtagtcaccgttactacgtttgaccgtagggtaccgaaggtagagagtacgaggacgaacgttaggtggtactcgacgaccagtccgtagttccttactcttacccg

SEQ ID NO: 174995 - DNA, 515 bp, Homo sapiens
  misc_feature: GYAE6OF02GD3LM.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagtattttgctaatgtattactgtcagcaatatcgctccacccccgatccaccttcggaccaagggacacgactcgcagatacgaaacgaacgtgtacgctagcacctatctgtcttac

SEQ ID NO: 174996 - DNA, 568 bp, Homo sapiens
  misc_feature: GYAE6OF02G0IMH.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccagggacagagccacctctcctgcgggccagtacaaattcgtacccgcgactacttagcctggtaccagcagaaacctggccaggcctacccagacctcctcactccaacaatatattctacgagggccgcggcactcccgagacaggttcaggtggcaggtcggctgggacagacttcactctcaccatcagcagactggacgtcctagaagtatttagactaagtgttattacgtgtacagtacaatactacgtcctacccgaccccgtatacctacccgttaccgaccgtaacggacaccgacgtcgacagtacgtaacgaaacgtacgtcgtacggtacgtcgaccaacctactacttgtaccttacg

SEQ ID NO: 174997 - DNA, 505 bp, Homo sapiens
  misc_feature: GYAE6OF02IST0F.21.33.C11.1.454.CMB.1.raw
  modified_base (375)..(375): a, c, t, g, unknown or other
  misc_feature (375)..(375): n is a, c, g, or t
  modified_base (488)..(488): a, c, t, g, unknown or other
  misc_feature (488)..(488): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctnaccatcagcagactggagcctgaagattttgcaatgtattactgtcagcaatatgctccacccccgatcaccttcggccaagggacacgactgcagatgaaaccgaatgtggntgcaccatctgtcttac

SEQ ID NO: 174998 - DNA, 519 bp, Homo sapiens
  misc_feature: GYAE6OF02F319W.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctccagactcctcatccacaatatattctacagggccgcgggcatcccagacaggttcagtggcagtgggtctgggacagacttcactctcaccatcagcagactggagcctgaagtattttgactaatgtattactgtacagtcaatatgctaccaccccgtatcctaccgttcggaccaacgggacacgactcgacacgatacgaaacgtactgtcgctcgcaccatctgtcttc

SEQ ID NO: 174999 - DNA, 543 bp, Homo sapiens
  misc_feature: GYAE6OF02GY0SZ.21.33.C11.1.454.CMB.1.raw
  modified_base (441)..(441): a, c, t, g, unknown or other
  misc_feature (441)..(441): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcgggccagtcaaattcgtacccgcgactacttagcctggtaccagcagaaacctggccaggctccagactcctcactccactaatactattctaacgacgggccgcgggcactcccagacaggttcaggtgcagtgggtctgggacagtacttcactctacacatcagcagacgtggacgctagaagtatttgactaatgtattactgtacagacaatntacgcctaccgaccccgactaccgaccgttaccggaccgaacggacaacgactcgacagacgtaacgaacgacgtcgtagactgacctaccatctcgtctac

SEQ ID NO: 175000 - DNA, 532 bp, Homo sapiens
  misc_feature: GYAE6OF02FU5OF.21.33.C11.1.454.CMB.1.raw
  modified_base (330)..(330): a, c, t, g, unknown or other
  misc_feature (330)..(330): n is a, c, g, or t
  modified_base (513)..(513): a, c, t, g, unknown or other
  misc_feature (513)..(513): n is a, c, g, or t
tcagtcgtcgctcgcacgaccggtgctcgatttagagtgagctcgttgggtttgggggggagaagagcgtgactcagtcaggacccagacgggaaccatggaaacccccagcgcagcttcctccttcctcctgctactctggctcccaggaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccncgggcatcccagacaggttcagtggcagtgggtctgggacagacttcactctcacccatcagcagactggacgcctagaagattttgcaaatgtattaacttgtcagacaattatgctccacccccgatccacctttcggacctaagggacaccgactgcagactagaaaccgaactcgtgcncgcaccatcctagtcttac

SEQ ID NO: 175001 - DNA, 512 bp, Homo sapiens
  misc_feature: GYAE6OF02GTM4W.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcacatcagcagactggagcctagaagtattttgactaatgtattactgtcagcaatatgctccaccccgatccaccgttcgaccgaagggaccacgactgcagactagaaacgacgtgtggctgcaccatctcgtctac

SEQ ID NO: 175002 - DNA, 511 bp, Homo sapiens
  misc_feature: GYAE6OF02G39TF.21.33.C11.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccncgggcatcccagacaggttcagtggcagtgggtctgggacagacttcactctcaccatcagcagactggacgcctgaagtattttgcaatgtattactgtcagcaatatgctaccacccccgtatccaccttcgccaaggacacgactgcagagtcgaaacgaacgtgtcgctagcaccatctcgtctc

SEQ ID NO: 175003 - DNA, 530 bp, Homo sapiens
  misc_feature: GYAE6OF02GT2U4.21.33.C11.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacatctcctgcgggccagtcaaattgttacccgcgactacttagcctggtaccagcagaaacctggccaggctcccagactccncatccacaatatattctacagggccgcgggcactcccagacaggttcagtggcaggtgggtctgggacagacttcactctcaccatcagcagactggagcctagaagtattttgactaatgttattactgtacagacaatatcgcctaccacccccgatcctaccgttaccggaccgaacggaccacgactcgacagactacgaacgaactagtcgtctcgacaccgatcgtgtac

SEQ ID NO: 175004 - DNA, 530 bp, Homo sapiens
  misc_feature: GYAE6OF02HKYEK.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcacatcagcagactggacgcctagaagtatttgctaatgtattacgtgtcagacaatatgctccacccccgtatcctaccttcggaccaacgggacacgactcgactagacgtgtaaaccgaacgtgtcggactcgacaccatccgttcgtcttacc

SEQ ID NO: 175005 - DNA, 497 bp, Homo sapiens
  misc_feature: GYAE6OF02G48MK.21.33.C11.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccncgggcatcccagacaggttcagtggcagtgggtctgggacagacttcactctcaccatcagcagactggagcctgaagattttgcaatgtattactgtcagcaatatgctcaccccgatcaccttcgccaaggacacgactgcagatgaaacgactgtgctgcaccatctgtctc

SEQ ID NO: 175006 - DNA, 572 bp, Homo sapiens
  misc_feature: GYAE6OF02GH1PR.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggcctcccagacctcctcatccacaatatattctacgagggccgcgggcactcccagacaggttcagtggcaggtgggtctgggacaggacttcactctcaccatcagcagacgtggagcctagaagtattttagactaatgtattactgtcagactaatatcgcctcccgaacccccgtatacctaccgttccggaccgaacgggaccaacgactcgacgacgtaacgtaacggaaaccgtacgtacggtacgtacgtacgacctaccgtactacgttcgttaccttaccg

SEQ ID NO: 175007 - DNA, 523 bp, Homo sapiens
  misc_feature: GYAE6OF02GEV6P.21.33.C11.1.454.CMB.1.raw
  modified_base (245)..(245): a, c, t, g, unknown or other
  misc_feature (245)..(245): n is a, c, g, or t
  modified_base (481)..(481): a, c, t, g, unknown or other
  misc_feature (481)..(481): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgngactacttagcctggtaccagcagaaacctggccaggctcccagactcctcatccacaatatattctacagggccgcgggcactcccagacaggttcagtggcaggtgggtctgggacagacttcactctcaccatcagcagacgtggacgcctagaagtattttagactaattgttaattacttgtcagacaatatgctccaccccgatccaccttccgaccaagggacacgacngcagacgtagaacgtactgtgctcgcaccatctcgtcttacg

SEQ ID NO: 175008 - DNA, 551 bp, Homo sapiens
  misc_feature: GYAE6OF02GQH3D.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgccggggccagtcaaattgttacccgcgactacttagcctggtaccagcagaaacctggccaggctccagactcctcatccacaatatacttctacgaggccgcgggcatcccagacaggttcagtggcaggtggtctgggacagtacttcactctcaccatcagcagacgtcggcgcctagaagtatttgcgtagtgtattacttgtacatatgtagtggtagtcaccgtactaccgttggccgagggaccgtaaggtggagacgtacgaacgacggtaacgtcggtcggtctcggaccgtaccacgttccgtagttcttactacttcccg

SEQ ID NO: 175009 - DNA, 516 bp, Homo sapiens
  misc_feature: GYAE6OF02GNUMT.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctccagactcctcatccacaatatatctacagggccgcgggcatcccagacaggttcagtgcagtggtctgggacagacttcactctcaccatcagcagactggagcctgaagtatttgacaattgtattactgtcagcaatatgctccacccccgatccaccgttcggaccaacgggacacgactgacagagtacgaaacgaacgtgtcgactcgcaccgtatctgtcttac

SEQ ID NO: 175010 - DNA, 546 bp, Homo sapiens
  misc_feature: GYAE6OF02IG70I.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggctcccagacctcctcatccaacaatatattctacgagggccgcggcatcccagacaggttcagtgcaggtgggtctgggacagacttcactctcaccatcagcagactggacgcctagaagtattttgactaatgttattacttgtacagtacaatatgcctacccacccccgactcctaccgttcggaccgaacgggaccacgacgtcgacagagtacgaaaccgtaacgtacgtcggactcgacacctatactcgtcttacc

SEQ ID NO: 175011 - DNA, 547 bp, Homo sapiens
  misc_feature: GYAE6OF02ILVM6.21.33.C11.1.454.CMB.1.raw
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgcgggccagtcaaattcgttacccgcgactacttagcctggtaccagcagaaacctggccaggcctccagactcctcactccacaatatattctacagggccgcgggcagtcccagacaggttcaggtgcagtggctgggacngacttcactctacacatcagcagctggacnctagaagtatttgactatgttattacgtgtacagtactaatatcgtcctcccgaccccgtatccgtaccgttcggaccgaacggtacaccgacgtacgcgacgagtacgaaacgacgtacggtacgctacgacctaccgactcgttcgttctacc

SEQ ID NO: 175012 - DNA, 570 bp, Homo sapiens
  misc_feature: GYAE6OF02ITQQT.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgtacccgcgactacttagcctggtaccagcagaaacctggccaggctcccagactcctcatccacaatatattctacaggccgcgggcatcccagacaggttcagtggcagtgggtctgggacaggacttcactctcaccatcagccagactggagctagaagtatttgactaatgtattactgtcagcaatatagactcctacccccggtatacctaccgttccggtaccgaaacgggtaccaacgtaaccgtcgaccgagtaacgtacggaaaaccgtacgtacggttacggaccgttacgaccgaacccacgttacctacgttaccttaccg

SEQ ID NO: 175013 - DNA, 649 bp, Homo sapiens
  misc_feature: GYAE6OF02JM7HW.21.33.C11.1.454.CMB.1.raw
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (370)..(370): a, c, t, g, unknown or other
  misc_feature (370)..(370): n is a, c, g, or t
tcagtcgtcgctcgcacgaccggtgctcgatttagagtgagctcgttgggtttggggggtaggaaggaggctgctcagtcaggacccagagggaaccatggaaacccagcgcagcttctcttcctcctgctactctggctccagaaaccaccggagagattgtgttgacgcagtctccaggcaccctgtctttgtctccaggggcagagccaccctctcctggcggggccagtcaaagttcgttaccccgngacttaccttagcctggtaccngcagaaacctggccaggctcccagactcctcactcccaacaactatattacctacacggggcgaccggggctatccccagacacgggttcagtcggnacgtggggtcgttggggacaggactttcgactctaccaccgtatcaggtaccagtacgtagggacgtccgtacggaacgtagttttacgactaaagttcggtaatttaaccgttgtactacggactaaacttacttaggcttacccgtacccccgactttaccacccgtttacggtacccgaaacgggtaaacccaccgtaaccgtacgtcaacgacgttaaccggaaaacgtacgtacggtcgaccggtacgaccacccgattccgtgttaaccttcg

SEQ ID NO: 175014 - DNA, 544 bp, Homo sapiens
  misc_feature: GYAE6OF02IRLG8.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccacctctcctgcggggccagtcaaattcgttacccgcgactacttagcctggtaccagcagaaacctggccaggctccagactcctcatccacaatatattctacaggggccgcgggcatcccagacaggttcagtggcagtgggtctgggacagacttcactctcacatcagcagactggacgcctgaagtatttgactaatgtattactagtcagcaatatcgctccacccccgtatacctaccgttccgaccgtaacgggaccaacgacgtacgacacgaacgtagaaaaccgtacgtcggtcgactcgactaccagtctcgtacttacg

SEQ ID NO: 175015 - DNA, 504 bp, Homo sapiens
  misc_feature: GYAE6OF02HOVG1.21.33.C11.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctccagactcctcatccacaatatattctacagggccncgggcatcccagacaggttcagtgcagtggtctgggacagacttcactctcacatcagcagactggagcctgaagtatttgctaatgtattactgtcagtcaatatgctcctacccccgatccaccttcgaccgaaggacacgactgacagagtgaacgactgtcgctgacaccatctgtctac

SEQ ID NO: 175016 - DNA, 539 bp, Homo sapiens
  misc_feature: GYAE6OF02FGYFZ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggctcccagactcctcatccacaatatattctacaggccgcgggcatcccagacaggttcagtggcagtgggtctgggacagacttcactctcaccatcagcagactggagctagaagtatttgactaatgtattactgtcagcaatatgctccaccccgtatcctaccttcggaccaacgggaccacgacctgaccgagacgtaacggaaaccgtaacgtcggtacggctacggacctaccatccttcgttcttaccg

SEQ ID NO: 175017 - DNA, 596 bp, Homo sapiens
  misc_feature: GYAE6OF02HIUY1.21.33.C11.1.454.CMB.1.raw
  modified_base (374)..(374): a, c, t, g, unknown or other
  misc_feature (374)..(374): n is a, c, g, or t
  modified_base (412)..(412): a, c, t, g, unknown or other
  misc_feature (412)..(412): n is a, c, g, or t
  modified_base (562)..(562): a, c, t, g, unknown or other
  misc_feature (562)..(562): n is a, c, g, or t
  modified_base (570)..(570): a, c, t, g, unknown or other
  misc_feature (570)..(570): n is a, c, g, or t
tcagtcgtcgctcgcacgaccggtgctcgatttagagtgagctcgttgggtttggggggagaagagctgctcagtcagggacccagagggaaccatggaaaccccagcgcagcttctcttcctcctgctactctggctccaggaaaccaccggagagattgtgttgacgcagtctccaggcaccctgtctttgtctccgaggggacagacgcccacctctccgtgcggggccagtcaaattcggttacccgcgacttactagccgtggtaccagcaacgaaacctgggaccacggcctcccagtacctcctcactccaactaatatacttctacgacgggccgacggcaactccagactggttcaaggtgacgnggtcgggtacgtgggacacgtacttcactctaccaacngtacaggcacggtacctggactcgtaggtaattagtttcgactaattgttattactgtacagtactaatagtacgccttacccgacccctgtacccgtaccgttaccggaccgtaacggactacgactcgacgtagtacgacgtaaacgngtcggtcncgtacgacacctatcttcgtattccg

SEQ ID NO: 175018 - DNA, 719 bp, Homo sapiens
  misc_feature: GYAE6OF02IPYUA.21.33.C11.1.454.CMB.1.raw
  modified_base (302)..(302): a, c, t, g, unknown or other
  misc_feature (302)..(302): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccacctctcctggcggggccaggtcaaattcgttacccgcgactacttagccttggtaccagcaagaaacctggccaggcctccagactccctnactccaacaatatacttactacgacgggtccgcgggcaactcccgagaccgtacggttccaaggtcggcctaaggtcgggttactacgggggtaaccaggtaccgttcaacttaccttcaaccctagttaccgacgaccgtaacgtacgttacgggaacgtaccgttaggtaaacgttagttttacgaacgttaacgttagttaactttacgttacgttacgtacgtactaaattacgtacgtcttacccgaccccccgtagtacccgtacccgtttaccggaaccgtaaacggacgtaaccgtacgttacgacgaacggtaacgtaacggaaaaccggtaacgttacggttaccggtaccggtaccgtaacccgtaacccggttaacgtaccgtttacggttacccgtttaacccg

SEQ ID NO: 175019 - DNA, 674 bp, Homo sapiens
  misc_feature: GYAE6OF02JZJ2C.21.33.C11.1.454.CMB.1.raw
  modified_base (261)..(261): a, c, t, g, unknown or other
  misc_feature (261)..(261): n is a, c, g, or t
tcagtcgtcgctcgcacgaccggtgctcgatttagagtgagctcgttgggtttggggggtaggaaggaggcgtggctcagtcaggacccagagggaaccatggaaaccccagacgcagcttctcttcctcctgctactctggctccagaaccaccggagacgattgtgttgacgcagtctccaggcaccctgtctttgtctccgaggggacagacgccaccctcgtccctgcggggccaggtccaaattcgttaaccccgngaccttacttacggcctaggtacccaggctagaaacctggaccaggcctcccgagacctcctacacgtccacgaactatactttacaccacgggtccgacgggcaactcccgaagaccagggtttccagtcggacacgttggggtacgtgggtacacgggtacttacggacttcgtaccacctaaacggttccaaggtccgaataaccggtacggaacgtcccgtagaacgtacgttttagacgaacgttgttaacttagttacggttacacggtacaattagacgtactccaaccccgtgtacccacgttcccgactaacgggacaaccgttacgacggtcagtacgaacgtaaaccgaacgtacgaacgcggtttacgaaccgtacctaccggtacttacggttacctacg

SEQ ID NO: 175020 - DNA, 541 bp, Homo sapiens
  misc_feature: GYAE6OF02FKJHD.21.33.C11.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgtacccgngactacttagcctggtaccagcagaaacctggccaggctcccagactcctcatccacaatatattctacagggccgcgggcatcccagacaggttcagtggcagtgggtctgggacagacttcacttctcaccatcagcagactggagcctagaagtattttgctaatgtattacttgtcagcaatatgctaccacccccgtatcctacgttccgaccgaaacgggaccaacgtacctcgacagtatacgaaacgtaacgtcgtacggctacgaccacctactcgtcgttcttaccg

SEQ ID NO: 175021 - DNA, 523 bp, Homo sapiens
  misc_feature: GYAE6OF02JIIVQ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagctgaagtatttgctaatgtattactgtacagacaatatgctccacccccgatactaccttcggaccaagggacacgactcgacagacgtacgaacgtacgtgtacgctcgcacctatctacgtcttaccg

SEQ ID NO: 175022 - DNA, 613 bp, Homo sapiens
  misc_feature: GYAE6OF02FWH7J.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccagggacagagccaccctctcctgcggggccagtcaaattcgttacccgcgactacttagccctggtaccagcagaaacctggccaggctcccagactcctcatccacaatatattctacagggccgcgggcactcccagaccaggttccagtggcaggtgggtcgtgggacagacttcactctcaccatcagcagactggacgctgaagtattttgactaattcgtattacgttgtactagtccaaattatacgtcctacccgacccccgtatcccgtaaccttaccgggacctaaacggggtactaaccggtaccttacgacgtaacggtaacgtaacggaaaaccgtaacgtcggtttaccggtacgttacgtccgtaaacccgtacgttaccgttacggttccctttaacccg

SEQ ID NO: 175023 - DNA, 588 bp, Homo sapiens
  misc_feature: GYAE6OF02IRN2D.21.33.C11.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaacccaccggagagattgtgttgacgcagtctccaggcaccctgtctttgtctccaggggacagagcccaccctctcctgcggggccagtcaaattcgttacccgcgactacttagcctggtaccagcagaaacctggccaggcctcccagacctcctcatccaacaatatattctacagggccgacgggcatcccagacaggttcagtgcagtgggtctgggacagtacttcactctacaccatcagcagacgtggacgcgtagaagtatttacgactaagttntattactgtcaagtctaaatatcgtactcccgtaacccccgtactacccgtacccgttaccggacccgaaacgggaccaacgtactacggacagaacgtaacggaaacgtacgttaggtacgtcgtacgcctaacctacgtcttacgttacttacccg

SEQ ID NO: 175024 - DNA, 788 bp, Homo sapiens
  misc_feature: GYAE6OF02JOXA2.21.33.C11.1.454.CMB.1.raw
  modified_base (756)..(756): a, c, t, g, unknown or other
  misc_feature (756)..(756): n is a, c, g, or t
tcagtcgtcgctcgcacgaccggtgctcgatttagagtgagctcgttgggtttggggggtaggaaggaggcgtgctcagtcaggaccagagggaacatggaacccagacgcagctctcttcctcctcgctactctgctccagaaccaccggagagacttgtgttgacgcagtctccaggcaccctgtctttgtctccaggggaccaggagcccaccctcctccgtgccgggggccacggttcaaaagtttcgttaccccggcgaccttacgtttacgcccttggtaacccagacctaacgaaaacccgtgggcccaaggggtcctaccccccgaagtacccccttcctaacgtcccaacctaacgttaattaacttaccttttaaccggaccgggccgggtcccgggccgggaaactccctaaccgaagtaacgttaccgggttacgaaggtcccggaggttagggttcccgggggtgtaaaccggaacggtaccctttaggtaacccttcccttaccgtaacccactaaaggtccacgaaggaaccgttggaaccgtcgtaacgtacgggtaatttacgttagtaaactgttaacgtttaactcgttacgttaacgacctaacgttaaatcgggtccttaccctaaccccccggtaccaaaccgtttaaccccgtggttaaccccggtaaaccggacggtaaaccggaccgttacaccggtgaaacgttcgaaacggtaacgtagtccgtaacgngtaccctgtactacgtcctacggttacgtccc

SEQ ID NO: 175025 - DNA, 586 bp, Homo sapiens
  misc_feature: GYAE6OF02IVE6P.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgtacccgcgactacttagcctggtaccagcagaaacctggccaggcctcccagactcctcactccaacaatatacttctacacgggccgcgggcactcccagacagttcagtgcagtgggtctgggacagtacttcactcacaccatcagcagactggacgcctagaagtatttgactaagtagtattacgtcgtcgagactaatatcgtcctacccacccccgattacccaaccgttccggaccgtaaacgggacccaaccggtactacgacgaagtaacgtaacggaaaaccgtacgtacggtacggaccgtacgacctaccgtacgttacttacgttccttaccg

SEQ ID NO: 175026 - DNA, 677 bp, Homo sapiens
  misc_feature: GYAE6OF02H414O.21.33.C11.1.454.CMB.1.raw
tcagtcgtcgctcgcacgaccggtgctcgatttagagtgagctcgtttggggttttggggggggagaagaagcgtgctcagtcagggacccagacgggaaccatgggaaaccccaggcgcagcttctcttcctcctgctactctggctccgagaaaccaccggagacgagttcgttgttgaccgcacgtctccacggcaccctgtctttgtcgtccacgggacagacgccacctctcctgcgggccagtcaaattcgtacccgacgactactagccgtggtacctagtcagaaccttggaccacggacctcccgacgacctccctacactccaactaatacgtacttactacgacggggccgtcggggtcacgtcccacgtactacggttcgacgttcggacgtacggtcgggtactacgggaccgacgtacttcaactactccactacgtcacgcgacgacgtacggacgccgtagaacgtattttgactaagttcgtacttactagtcacgctaagtactagtcctaccgtaccccggtataccgtaccgttacgggacccgtaagggtaccgtaacgtacgtacggtaccgaacggtaccgtaacggaaaccgtaccgttccggtacggaccgtacgtaccgtaccgtaccgttccgttccgttacttacccgg

SEQ ID NO: 175027 - DNA, 664 bp, Homo sapiens
  misc_feature: GYAE6OF02IKV75.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctggccggggccagtactaaattcgttacccgcgactacttagctggtaccagcagaaacctggccaggcctcccagacctcctacactcccaacaatatactttctacgacggggccgcgggcactccccaagactacggttcagtcggacaggtgggtctgggacagtaccttcactctaccaccatcgagcagacgtaggacgccgtagaagtatttgactaatgtattacgttgtacagtacctaattactacgtccctacccgaacccccgtacttacccgtacccgttaccgggaacccgtaaaccggggtaaccaaccggtaaccgttacggaccgtaacggtaaccggtaaacggaaaaccggtaaccggttcggttaaccgggtaccgttaccggaccgtaacctacgttaccgtttacgttacccgttaacccg

SEQ ID NO: 175028 - DNA, 656 bp, Homo sapiens
  misc_feature: GYAE6OF02IWACA.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctccagaaaccaccggagagattgtgttgacgcagtctccaggcacctgtctttgtctccgaggggacagagccacctctcctgcgggccagtcaattcgttacccgcgactacttacgcctggtaccagcaagaaacctggccaggcctacccagacctcctcactcccaacaatatacttctaacgacgggcccgcgggacactcccgaacgacgtacgggttacaggtcggactaggtcgggtctgggacaggtaccttcactctacaccagtcacgtcagacgtcggacgcgtagagtatttagactaagtagttacgttacgttacgtacgtagtaacctaattacgtacgtaccgttacccgaaccccgttacctacccgtaacccgtttaccggacccggtaaacgggtaacctaaccggtaaccgtacggacgtaacggtaacgtaacggtaaaccgtaccgttacggtacgtccggtacgaccgtaaccgtagtaccttacgttacgttaccg

SEQ ID NO: 175029 - DNA, 601 bp, Homo sapiens
  misc_feature: GYAE6OF02I068Y.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaaccaccggagagattgtgttgacgcagtctccaggcacctgtcttgtctccaggggacagagccaccctctcctgcgggccagtcaaattcgtaccgcgactactagcctggtaccagcagaaacctggccaggctcccagactcctacatccaacaatatattcacaggccgcggcactccagactaggttcagtgcagtggtctaggcagctcactctacacactcagacgagacgtaggacgacctagaacgtagtttacgactaagtagttaacttacttgtacgaacgtactaaagtatacggacctacccgtaccccgacttacctacccgttaccggacccgtaacgggacctaaccgaccgtacgtaccgagtaacgtaacggtaaacgtaacgtacggtacggtaccgtacgtaccgaacccgtagttaccttacggttaccttacccg

SEQ ID NO: 175030 - DNA, 803 bp, Homo sapiens
  misc_feature: GYAE6OF02J2CIM.21.33.C11.1.454.CMB.1.raw
tcagtcgtcgctcgcacgaccggtgctcgatttagagtgagctcgttgggtttgggggagaagagctgctcagtcaggacccagagggaaccatggaaccccagcgcagcttctcttcctcctgctactctggctcccagaaccaccggagagattgtgttgacgcagtctccaggcaccctgtctttgtctccaggggacagacgccaccctctcctgcggggccagtccaaattcgttacccgcgactacttagcctggtaccagcagaacctggccaggctcccagactcctcatccacaatatattcgtacacgggtcccgcgggtacacttccccgaaggacctacgggtttccaaggttcgggacctaacggttcggggttaccgttcgggggacctagggtaccctttccggaaaccgttccttacccgaaaccccgtaagttacccgaacggggtaccctaaacggtaacccggttacggggaaccggtaccccgttaagggaaacggtttacgtttttacggaccgttaaacgtttacggttaaacgtttaaccgttcggttaccgtaacggtaccgtaaacgttaacgttaccggtacccgttaccccgaacccccccggttaattaccccgtaacccggtttacccggaacccgtaaaccgggtaaccgtaacccgtaccgttaccgaccgtaacgtaacgtaaccggtaaaccggtaacgttacggtaccggtaccgttaccggtacccgtaacccgttacgttacccgttaccggttacctttaccccgg

SEQ ID NO: 175031 - DNA, 789 bp, Homo sapiens
  misc_feature: GYAE6OF02H97W6.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttacccgcgactacttagcctggtaccagcagaaacctggccaggctccagactcctctatttaccgtgactactccaccacgggcctacgtcggtcgtcccagacgaggttcagtggcggtggtagtttcgggactaggtacgttttctcgttctaaccgatcgaacgtccgaccccttaacgtaacggtacggttaggaaagtacttcgggtttagtaccgttaaggttttttaacgtttccgttacgcccgtaaggtaccttaaagtttaaacttaaacgttttaaccgtcggggtacccctttcgggtaccggtttaccgggttaaccgggtttttacccgggaccccgggttaaaaccggggggtaccccttaaaaggggggtttaaccgtaaaaaacgttaacccggtaaaaaccggtaaccgtttacgggttacgggtaacccgttcggtaacccgtaacccgtacgttttacccgtacggttttacctttacccggttaaccgtttccccgttttacccccgggacccttagtttaccccgg

SEQ ID NO: 175032 - DNA, 668 bp, Homo sapiens
  misc_feature: GYAE6OF02JS728.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacagagccacctctccgtggcgggccagtcaaattcgtacccgcgactacttacgcctggtaccagcaacgaaacctggaccaggcctccgagcctcctcactaccactaatactacttctaaccgaggtaccgccgggactactacccagtacgtacggttaccgaggtcgcggtaggttcggggtactacgggactacggtcttacgactcgtcacctatcgagtcgagacgtggacgtaccgtagtaacgtactttgactaagttagtacttacgttgtacgactacgtaatagtcgtacctacccgaccccgttaacttccgtaacccggtttaccggaaccgtaaacggtacccgtaaacgtacccgtaggaccgtaaggtacggtaaccgaaaacgtaccggtagtaaccgggtacctacgaccgtaaccttacgttaccgttacgttacccgttacccg

SEQ ID NO: 175033 - DNA, 643 bp, Homo sapiens
  misc_feature: GYAE6OF02IX5KT.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattcgttaccgcgactacttagcctggtaccagcagaaacctggccaggctcccagactctcatccacaatactattactacagggccgcgggcatacccagacaggttcagtgcagtggtctcgggacagacttcactctacaccatcagcagacgtggacgacctagtaagtaattttcggactaaagttagttaatttaacgttacgttacgagaaccgtaaagttaactacggtcctacccctaaccccccggtaatacccgtaacccgtttaccgggaccccggaaaacgggaccgtaaccgacgttaccggacgaacgtaacggtaaccggaaaccggaaacgttcggtaccggtacgtaccgacccgtaacctaacgttaccgttacgttacctttaacccg

SEQ ID NO: 175034 - DNA, 600 bp, Homo sapiens
  misc_feature: GYAE6OF02HZC9M.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcaagaaacctggccaggcctcccagacctcctcactccaacaatatattctacgagggcccgcggcactccaagacagggttcaggtcggcgaggtcggggtctcggggacaggtaccttcaacttcaccacatcagcagacgtggagccgtagaagtatttgactaagttgttattacgtgtacagacctaatatcgtacctacccacccccgtatccctaccgtttaccgggaacctaacgggtaccaccgactacgacgaacggtacgtaacggaaaccgtacgtacggtcggtacgtcggacctaccgtagtccgttcgtaccttaccg

SEQ ID NO: 175035 - DNA, 527 bp, Homo sapiens
  misc_feature: GYAE6OF02H2EIC.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaacccaccggagagattgtgttgacgcagtctccaggcaccctgtctttgtctccaggggacagagccaccctctcctgcggggccagtcaaattgttacccgcgactacttacgcctggtaccagcagaaacctggccaggctcccagactcctcatccacaatatattctacagggccgcgggcactcccagacaggttcagtggcagtgggtctgggacagacttcactctcaccatcagcagacgtggagctagaagtagtttgacaatgtattactgtacagtacaatatgcctaccacccccgatccaccgttccggaccgaacggacacgactcgacagactagaaacgtactgtcgactgacaccatctgtctac

SEQ ID NO: 175036 - DNA, 569 bp, Homo sapiens
  misc_feature: GYAE6OF02GS8NV.21.33.C11.1.454.CMB.1.raw
  modified_base (327)..(327): a, c, t, g, unknown or other
  misc_feature (327)..(327): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgccggggccagtcaaattgttacccgcgactacttagcctggtaccagcagaaacctggccaggctcccagacctcctcactccacaatatattctaacagggccncgggcatcccagacaggttcagtgcagtgggtctgggacagacttcactctcaccatcagcagactggagcctagaagtatttagactaagttgtattactgtacagactaatatcgacctaccacccccgtatacctacccgttaccggaccgtaacgggactaaccgacgtacgcaacgtacgaacggtaaacgaacgtacgtagacgtacgacctaccgtagtaccttcgtacttaccg

SEQ ID NO: 175037 - DNA, 568 bp, Homo sapiens
  misc_feature: GYAE6OF02FRE94.21.33.C11.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagactcctcatccacaatatattctacagggccgcgggcatcccagacaggttcagtggcagtgggtctgggacagacttcactcncaccatcagcagactggacgctgaagtatttgactaatgtaattactgtcagtacaattatacgctaccgacccccgtactccctaccgttccggaccgtaaacgggacaacgtacgtacgacgaacgaactacggaaaccgtaaccgtgttacggaccgttcgacctaaccgtacttccttacgttccttaccg

SEQ ID NO: 175038 - DNA, 587 bp, Homo sapiens
  misc_feature: GYAE6OF02IGNGL.21.33.C11.1.454.CMB.1.raw
  modified_base (297)..(297): a, c, t, g, unknown or other
  misc_feature (297)..(297): n is a, c, g, or t
  modified_base (394)..(394): a, c, t, g, unknown or other
  misc_feature (394)..(394): n is a, c, g, or t
tcagtcgtcgctcgcacgaccggtgctcgatttagagtgagctcgttgggtttgggggagaagagctgctcagtcaggacccagagggaaccatggaaacccagcgcagcttctcttcctcctgctactctggctcccagaaaccaccggagagattgtgttgacgcagtctccaggcaccctgtctttgctccgaggggacagagccaccctctcctggcgggccagtcaaattgttacccgcgactacttagcctggtaccagcaagaaacctggaccaggctccagtactcctnactccaacaatatagttcacgacgggccgacggcactcccagactacggttcagtggcaggtgggtctggggacacgtacttacactcgtcaactancagcaagacgtaggacgacctagaacgtatttagactaatagttattactagtacagactaaatatgacctccgaacccccgtactaccgtaccttaccggaccgaaacgggacacgacgtcacgtacgaacgtaacgaaaccgtaacgtaggtacggtcgtacggaccaaccgtattcgtacgttacttacc

SEQ ID NO: 175039 - DNA, 570 bp, Homo sapiens
  misc_feature: GYAE6OF02JY3RS.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgtacccgcgactacttagcctggtaccagcagaaacctggccaggctccagactctcatccacaatatattccacagggccgcggcactcccagacaggttcagtcggacaggtgggtctgggacagacttcgaactctcaccatcagcagactgacgctagagtatttcgactaatgtattactcgttacagtacaatatacgtcttaccgacccccgtatacctaccgttccgaccgtaacggaccaacgtactacgacacggtaactacggtaaaccgtacgtacggtacgtacgtacgaccgtaaccgtacgtacgttcgtcctttaaccg

SEQ ID NO: 175040 - DNA, 553 bp, Homo sapiens
  misc_feature: GYAE6OF02GFNUH.21.33.C11.1.454.CMB.1.raw
  modified_base (381)..(381): a, c, t, g, unknown or other
  misc_feature (381)..(381): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgcggggccagtcaaattgttacccgcgactacttagcctggtaccagcagaaacctggccaggctcccagactcctcatccacaatatattctacagggccgcgggcactccagacaggttcagtgcagtgggtctgggacagacttcactctcaccatcancagactggagcctagaagtatttgactaatgtattacgtgtacagacaatatcgtcctaccacccccgtatcctaccgttccggacctaacgggaccacgacgtcgacgagacgtaacgaaacgtaacgtacggtacggacgtacgaccaccgtatcgttcgttacttaccg

SEQ ID NO: 175041 - DNA, 676 bp, Homo sapiens
  misc_feature: GYAE6OF02JELUG.21.33.C11.1.454.CMB.1.raw
  modified_base (153)..(153): a, c, t, g, unknown or other
  misc_feature (153)..(153): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagtcgtcgctcgcacgaccggtgctcgatttagagtgagctcgttgggttgggggagaagagctgctcagttcaggacccagagggaaccatgggaaaccccagcgccagcttctcttcctctgctactctggctccagaaaccaccggangattgtgttgacgtcagtctcgaggcaccctgtctttgtcttccaggggtacagagtccaccgtctccgngtcgggccagtcaaattcgtaccgngactactagcctggtaccagcagaaccgtggccaggctcccagacctcctcgactccaactactgtacttcgtaaccgagggacccgcgggtaccacgtccccgaagtacgaacgggtttcaacggttggccgaaggttggggttaccttacggggaacacggtaaccggtttcgaccgttacgtacccgtaaccaacgttcgtaacgggtacctaacggtaccgtttacgggacgtacccggtaggtaaacgttacgttttagaccttaagtacgttacttacgttcgttacgcgtaactatacgtctacctccgacccctatcccgtaacttccggaccgaaggtccgaacgtcgttgacgtagtacgttaacgaaacgtacgtcggttacgctacggcctaaccgacgtccgttatccgttaacg

SEQ ID NO: 175042 - DNA, 709 bp, Homo sapiens
  misc_feature: GYAE6OF02IO2V9.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccacggagagattgtgtgacgcagtctcaggcaccctgttctttgtctccgaggggacagacgccaccctctcctggccggggccaggtactaaaattcggttaacccgcgtaactaacttacgccttggaccagcaacgtaaacctggaccaaggcctcccgagtacctcctcatccaacaatatacttctaacgacggccgcggccatacccagtacgtaaggttcgaggtcggacgaggtcgggtcgtagggactaacggtacgttcaacgtcctacaaccactacgaacgcaacggtactacggtacgaccgttaggaaacgttacgtttacgaaccgaaagtttaggttaacttacgttacgggttaacacggtaacctaagttaactccgtaacccgtacccgtaaccccccgtaactcccgtaacccggtttccggaaacccggtaaaggggtaaaccctaaccggaacccgttacggaactaacggtaacgtaacgaaaaccggttaccgtacggttacgcgttacggaccctactacggtacttacgtccttaacg

SEQ ID NO: 175043 - DNA, 535 bp, Homo sapiens
  misc_feature: GYAE6OF02GN9WT.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgtacccgcgactacttagcctggtaccagcagaaacctggccaggctcccagactcctcatccacaatatattctacagggccgcgggcatcccagacaggttcagtggcagtgggtctgggacagacttcactctcaccatcagcagactggacgcctgaagtatttgactaatagtattactgtacagacaatatgactccacccccgatcctaccgttccggaccgaacgggacacgactgacagagtaacgaaacgaacgtagtacggcgtacgaccacctatctacgtcttacg

SEQ ID NO: 175044 - DNA, 560 bp, Homo sapiens
  misc_feature: GYAE6OF02I7MMR.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggcctcccagacctcctcatccacaatatacttctacagggccgcgggcatcccagacaggttcagtggcagtcgggtctgggacagcttcactctcaccatcagacagacgtggacgtacctagaagtagttttgactaattgtattactcgtacagtacctaatatacgtacctacccgaccccgtactaccgtacccgttccgaccgtaacgggaccaacgactcgacagtactacgaaacgactggtacgatcgacacctctcttacgtcttacg

SEQ ID NO: 175045 - DNA, 571 bp, Homo sapiens
  misc_feature: GYAE6OF02JMN1Y.21.33.C11.1.454.CMB.1.raw
  modified_base (379)..(379): a, c, t, g, unknown or other
  misc_feature (379)..(379): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctggcgggccagtcaaattgtacccgcgactacttagcctggtaccagcagaaacctggccaggcctcccagacctcctcatccaacaatatattcgtacagggccgcgggcactcccagacaggttcagtcgcagtgggtctgggacagacttcgaactcncacatcacgcagacgtggacgcgagaagtatttgactaatgtattacgtgtctagactaatatcgtctaccgacccccgtactcctaccgttccggaccgaacggaccgacgacgttacgacgaacgacgtacgtaaaccgtacgtacggtacggacgtacgacctacctacgtaccttcgttaccgttacc

SEQ ID NO: 175046 - DNA, 559 bp, Homo sapiens
  misc_feature: GYAE6OF02IQ6G6.21.33.C11.1.454.CMB.1.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctccagacctccncatccactaatatacttctaacgagggccgcgggacactcccagactaggttcaggtggcaggtgggtctgggacagtacttcactcncaccatcagcagactgagctagatattgactaatgtattactgtacagactaatatcgtcctaccgacccccgtatcctaccgttccggaccgaacggacacgtactcgacgtaacgagtaacggaaacgtacgtacggtcggacgtcgacctaccgactcgttacgttcttacc

SEQ ID NO: 175047 - DNA, 676 bp, Homo sapiens
  misc_feature: GYAE6OF02J2QOU.21.33.C11.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagacgattgtgttgacgcagtctccaggccacctgtctttgtctccgaggggacaggacgccaccctctcctggccggggcctaggtacaaactttcgtacccgcgactacttagcctggtaccaggcaagaacctgtccaggcctccagtacctccncactccaataatacttacttcgtaacgacggggccgacgggtcaaccgtcccgaagacgtacggttacgacggtcggtccagggttcgggtacgtgggaacctggtaaccttcaccttctaccgacctataccgagaccgtagacgtcggacgtaccgtaggaacgttatttacggactagttacgttacgttacgttgtacctagtactaacgtactcgtacccgtaccgtaacccccgtattacccgtacgttaccggtaaccgaaacggaccgtaacgtacgtaccgtacgaacgttacgtaaccgaacgtaccgtaggtaccggacgtacgtacaccgttagtaccgttacgttaccttaccg

SEQ ID NO: 175048 - DNA, 546 bp, Homo sapiens
  misc_feature: GYAE6OF02J19KI.21.33.C11.1.454.CMB.1.raw
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
  modified_base (521)..(521): a, c, t, g, unknown or other
  misc_feature (521)..(521): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaacctggccaggctccagactcctcatccacaatatacttctacacgggccgcgggcactcccgagacaggttcagtggcagtggtctgggacagacttcacgtctacactatcagcgagacgtggacgccgtagaagtatttgactaagtgtattactgtacagtacatagtntcctccaccccgntacctaccgttcgaccgtaacggaccacgtactcgacgagacgtaacgaacgtacgtggtcgtntcgaccactatccttacgtcttacg

SEQ ID NO: 175049 - DNA, 623 bp, Homo sapiens
  misc_feature: GYAE6OF02HS3LF.21.33.C11.1.454.CMB.1.raw
  modified_base (534)..(534): a, c, t, g, unknown or other
  misc_feature (534)..(534): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagggccaccctctcctgcgggccagtcaaattgttacccgcgtactacttagcctggtaccagacagaaacctggccaggcctccagacctcctcatccaataactatacttctacgcgggccgcgggacactcccgagacgtaggttcagtcggacaggttcggtctgggacagcttcactctacacatcagtcagtacgtggacgtaccgtagaacgtatttcggactaaagttgttaactttacgttgtactagacctaagttactacgtaccctacccgtacccccgtatacccgtacccgttaccgggacccgtaagggaaccncggaacctcgaccgagtaacgtaacggaaacgaacggttgtacggtaccttaggaccctaacgtaccgttctcgttaccttacgtaccc

SEQ ID NO: 175050 - DNA, 622 bp, Homo sapiens
  misc_feature: GYAE6OF02H3Z1R.21.33.C11.1.454.CMB.1.raw
  modified_base (312)..(312): a, c, t, g, unknown or other
  misc_feature (312)..(312): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcctaccctctccgtgcggggccagtcaaattcgtacccgcgactacttagcctggtaccagcaagaaacctggccaggcctcccagactcctcactccanaatatattctacagggccgcggcatccagactaggttcagtggcaggtgggtctgggacagactcactcncacntcagcagactggacnccgtagaagtatttacgactaattgttacttacgttgtacagtactaagttacgtacgtcctacccgtaaccccccgtatacccgtacccgtttaccgggacccgtaaacggggtaccaaccggtacgtacgaccgaacggtaacgtaacggaaaccggtaacgtcggtacggtaccgtaccgtaccgtaaccctagttacccgttacgttcctttaaccg

SEQ ID NO: 175051 - DNA, 720 bp, Homo sapiens
  misc_feature: GYAE6OF02G6LFV.21.33.C11.1.454.CMB.1.raw
  modified_base (297)..(297): a, c, t, g, unknown or other
  misc_feature (297)..(297): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctcaggcaccctgtctttgtctccgaggggacagacgccaccctctcctgccggggccagtcaaattcgtacccgcgactacttagcctgtaccagcagaacctggccaggcctccagacctccncatccaacaatatacttcacgaggggccgacgggcactaccccaagaccgtaggttaccgaggttcggaccgtaggtcggggtactcgggggaacctaggtacctttacgaccttccgtaccaaccctagttccgacggacaacggtacgtacgggacgtcccgttaggtaaacgttagttttacggaccttaaagtttacggttaactttacggtttacgtacgtaacgtacttaaacgttacgtaacggcccttaaccccgtaacccccccgttagttaacccgtaacccgtttaaccgggacccgtaaaccggggtacctaaccgaacgtacgtaccgaagtaacggtaaacggaaaccgtaaccgtacggtacggtaccgtcggaccctaacgtacgtttacgtccgttaccttacccg

SEQ ID NO: 175052 - DNA, 649 bp, Homo sapiens
  misc_feature: GYAE6OF02GKF9R.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctggccggggccagtctaaattcgtacccgcgactacttagcctggtaccagcagaaacctggccaggcctccagacctcctcactccaactaatatattacctacgacgggccggcgggaccactaccccgagaaccgtagggttacaggtcggacgaggttggggtcgtagggacgacgtacttcaactccgtcaccatcagacgacgtacgtgggaacgtccgtagtaacgttatttcggaactaagttgtaactttacgtgtactagtactaaatagtcaccgttaccccaccccgtattaccctacccggttccggaacccggtaacggtacccgaacgaccgtgaccgtaacgtaacgtaacggaaactacggtcggtacgtccgtacgaccgtaaccttagttccgttagtcccgttaccg

SEQ ID NO: 175053 - DNA, 758 bp, Homo sapiens
  misc_feature: GYAE6OF02I0DXS.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattcgtacccgcgactacttagcctggtaccagcacgaaacctggccaggcctccgagacctcctacactacccactaaatactaattctaaccgaggggccggaccggggccaacttccccgaggtaaccgtaggtttaccgaaggttcgggacctagggttcggggtacgttacgggggaacctaaggtaacctttaccgacttaccctaaccgaccctaacgtaccgacggtccgaacgtaaccgttacgggaacggtacccgtaggtaaacgttaacgttttttacggacgttaaagtttacgtttaactttaaccgttagttaccgtaacggtaccttaaattaacgttaccgtaccctaccccgtaaccccccggtaatacccctaacccgttacccgggaaccgaaaccgggaccgtaaaccgtacgttacgaccgtagaaccgtaacggtaaaccggtaacgttacggtacggtaccgtacgtacctaaccgtactacgtttacgttccttaacccg

SEQ ID NO: 175054 - DNA, 665 bp, Homo sapiens
  misc_feature: GYAE6OF02IZ8M0.21.33.C11.1.454.CMB.1.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcacctgtctttgctccagggacagagccacctctcctgcgggccagtcaaattcgtaccgcgactacttagcctggtaccagcagaaacctggccaggctccagactcctcactccanaatatattctacaggccgcggcactccganacgaggttcagtggcaggtaggtcgtagggacaggtacttcaacgttcctacaccgtatacgacgtacaaggactggaacgtccgtaggaacgttagttttcggactaaagttacgttaaagtttaccggttacgttacgtacgaacgtaaacgttacgttacggtaccgttaccccgtaacccccggtaaactttcccgttaaacccggtttaccggaacccgaaaacggggtaaccctaacccggtaacgttccgaaccgtaacggtaacgtaacggaaaaccgtaacgttcggtacggtaccgtacaaccgtacctacgtcgttacgtcttacccg

SEQ ID NO: 175055 - DNA, 620 bp, Homo sapiens
  misc_feature: GYAE6OF02GH95R.21.33.C11.1.454.CMB.1.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatntccaggagcctaactacatacgcctggtaccagcagaagcctggccaggcctcccgaggttccctcattcctatcggcgtcggggtccccagacggggcccacgtggccactcccaaggacctagggttcaggtcggcgtaggtcggggtcgtggggacagtactttcactctcatctatagactacgacgtaggacgccgtagtaagtatttacggctagtgttacttacgttacgtcagtactaagttagtagtaacgttccgtaaccttcgttacggttcgttaccggaccggtaaacgggtaaccgtaagggttaaacgtaaacgttaacggaaacgtaacggttacggtacggtacgttacgaccgtaaccg

SEQ ID NO: 175056 - DNA, 689 bp, Homo sapiens
  misc_feature: GYAE6OF02HU4P6.21.33.C11.1.454.CMB.1.raw
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (423)..(423): a, c, t, g, unknown or other
  misc_feature (423)..(423): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgcgggcagtcaattcgtaccgcgactacttagcctggtaccancagaacctggccacggcncccagacctccctcacgtcccaactaattacttacttacctacgacggggcccgtcggggcctaactccccgaagacctaggttcaggtcgggacaggtgggtcgtgggactagtacctttcgaacctcctaccgaacccnttaccacggtacaacggactcgggacgtccgtaggtaaagttcgtttagactaagtcggttaatttacgttaggttacaaggtaacctaaagttacgtaccggtcccttaacccgtaaccccccgtaactcccgttaccggttacccggaaccgtaaaccggaccgtaaccgtaccacgtacaaggtaacgtaacgggaaaccgtacggttacggtacggtaccgtacgacccgtaacccgttacgtccttggttacccttacccg

SEQ ID NO: 175057 - DNA, 557 bp, Homo sapiens
  misc_feature: GYAE6OF02IDWYH.21.33.C11.1.454.CMB.1.raw
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctgcgggccagtcaaattgtacccgcgactacttagcctggtaccagcagaaacctggccaggctccagactccncatccanaatatattcacagggccgcggcactcccagacaacggttcaggtgcaggttcggggtctggggacagtaccttcaccgtctacaccatcagccagacgtggacnccgtagaaagtntttacgactaagttgttaattacgtgtacagactaatatcgacctccgacccgtactccgtaccgttccgaccgaacggacacgactgacagacgtacgaacgtactagtcgacgtcgacaccgtatcttactctacc

SEQ ID NO: 175058 - DNA, 637 bp, Homo sapiens
  misc_feature: GYAE6OF02HOB06.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccaccctctcctgcgggccagtcaaattgttacccgcgtactacttagcctggtaccagcagaaacctggccaggcctccagactcctcactccacaatatattctacgagggccgcgggcactccagacaggttcaggtggcaggtgggtctgggacagacttcactctacaccatcagacagacgtaggacgccgttaggaacgttagttttacgactaagttgttaacttacgtcgttacgaagtacctaaatacgttcgacccttacccgtaaccccccgtacttaccctaacccgtttaccgggaacccgtaaacgggaacccaaccggtaactcggaccgtaagtaacgtaacggaaaccggtaaacgtacggtacggtacctcggaccctaacccgtattaccgttacgtacctttaccg

SEQ ID NO: 175059 - DNA, 590 bp, Homo sapiens
  misc_feature: GYAE6OF02JFYGM.21.33.C11.1.454.CMB.1.raw
  modified_base (377)..(377): a, c, t, g, unknown or other
  misc_feature (377)..(377): n is a, c, g, or t
  modified_base (457)..(457): a, c, t, g, unknown or other
  misc_feature (457)..(457): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccacccgtctcctgcgggccagtcaaattcgtacccgcgactacttagccttggtaccagcacgaaacctgccaggctaccagactcctcatcccacaatactacttctacgacggccgcggcactcccagctaggttcagtgcagtcggctgggacacggtcttacncgtctacacatacgacgacgtacgactgacgcgtagaagtagtttgactattacgtattactgtacagtacgtatactcncgtacccaccccgtatcctaccgttccgaccgaaccgggtacaaccgtacgtacgtacaacgtaacgtaacgaaaccggtacgtacggtacgtcgaacggtacctacctaacggtacttcggttaccttaccg

SEQ ID NO: 175060 - DNA, 602 bp, Homo sapiens
  misc_feature: GYAE6OF02JVCJU.21.33.C11.1.454.CMB.1.raw
tcagtcgtcgctcgcacgaccggtgctcgatttagagtgagctcgttgggtttggggggaggaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccacctctcctgccgggccagtcaaattcgttacccgcgactacttagcctggtaccagcagaaacctggccaggctcccagacctcctcactccaacaattatacttcacacgggccgcggcactcccagactaggttcagtggcaggtgggtctacgggacagtacttcactcctcacagtcagcagactggacgcctaggaagtagtttacgactaagttcgttattacgtagttcacgtactaagtatacgtacctacccgaaccccgtatacctaccgttaccgggacctaacgggaccaaccgacgtcgacgtacgtaacgtaacggtaaactacgtcggttacgacgttcgaccctaaccgtacgtacctttagtaccctttaccg

SEQ ID NO: 175061 - DNA, 585 bp, Homo sapiens
  misc_feature: GYAE6OF02HOYIB.21.33.C11.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagagtgagctcgttgggtttggcgggagaagagctgctcagttaggacccagagggaaccatggaaaccccagcgcagcttctcttcctcctgctactctggctcccagaaaccaccggagagattgtgttgacgcagtctccaggcaccctgtctttgtctccgaggggacagagccacctctcctgcgggccagtcaaattgtaccgcgactacttagcctaggtaccagcagaaacctggccaggcctcccagacctcctcactccacaatatacttctacgagggccgcgggcactcccagactaggttcaggtcgcaggtgggtctagggacagtacttnactctcacatcagcagacgtggacgccgtagaatagtttagactaattgtaattacttagtacgagtactaatactcgcctacccgtacccccgtatacccgtaccgttaccgaccgaacgggaaccaaccggtacgtacgacgagtaacgtaacgaaaccggaagtcgtacggacgtacgaccgacctactacgttcgtcttaccg

SEQ ID NO: 175062 - DNA, 716 bp, Homo sapiens
  misc_feature: GYAE6OF02I7A9H.21.33.C11.1.454.CMB.1.raw
  modified_base (156)..(156): a, c, t, g, unknown or other
  misc_feature (156)..(156): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggaganattgtgttgacgcagtctccaggccacctgtctttgtctccgagggacagacgcccacctctccgtgcgggcctagtacaaattcgtacccgcgtactacgtagccgtgtaccagcaagaacctggccacggcctcccgagaccctcctcactcccaacatattacttctacgacggggccgcgggacactcccgaacgtcgtaggttcagtcgggactaggttgggtccgtagggaccacgtaccttacacgttctacccgactacgtacaaggtaccagggtacccgtagggtacggacccttaagggaacgtttacgttttagaaccgttaagttacggttaacgtttacgttacggttaccaagtaacctaaagttcgtacctacccgtaaccccggttacccccgtaacttcccgtaacccggttaccgggaacccggtaaacggtaccgaaccgtacgtacgaccgtaagtaacggtaaccgtaaaccggtacgttacgggtaccggtaccgtacggaaccttcccgaacttccggttacttacccgttaaccg

SEQ ID NO: 175063 - DNA, 547 bp, Homo sapiens
  misc_feature: GYAE6OF02GZQ69.21.33.C11.1.454.CMB.1.raw
  modified_base (244)..(244): a, c, t, g, unknown or other
  misc_feature (244)..(244): n is a, c, g, or t
  modified_base (440)..(440): a, c, t, g, unknown or other
  misc_feature (440)..(440): n is a, c, g, or t
  modified_base (540)..(540): a, c, t, g, unknown or other
  misc_feature (540)..(540): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgtacccgngactacttagcctggtaccagcagaaacctggccaggctccagactcctcatccaacaatatacttctacgagggccgcgggcactcccagacaggttcaggtggcaggtgggtctgggacagtacttcactctacacatcagcagacgtggacgccgtagaagtatttgactaatgtattactgtacagacaatntcgtcctacccaccccgtatccctaccgttccggaccgaacggacacgtactacgacagacgtaacgaaacgtactggtcgactacgaccaccagtcgtntcttacg

SEQ ID NO: 175064 - DNA, 587 bp, Homo sapiens
  misc_feature: GYAE6OF02HG64C.21.33.C11.1.454.CMB.1.raw
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtatttgtctccagggacagagccacctctcctgcgggccagtcaaattgtacccncgactacttagcctggtaccagcagaaacctggccaggctccagctcctnactccaacaatatattctacagggtccncggcactcccagacaggttcagtgcaggtggtctgggacaggtacttcacgttctacaaccgattaccgatcgaagacgtggacgtcctagaagtattttagactaagtgtattactgtactagtcctaaatatcgtacctaccgacccccgtatacctaccttaccggaccgaaacgggtaccaaccgaccgtagtacgaacgtacgtaacgaaccgtaacgtcggtacgacgttacgacgtaccctacgtcttacggtacttacccg

SEQ ID NO: 175065 - DNA, 577 bp, Homo sapiens
  misc_feature: GYAE6OF02IAAJU.21.33.C11.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcacctgtctttgtctccaggggacagacgccaccctctcctgcggggccagtcaaattgttacccgcgactacttacgcctggtaccagcaagaaacctggccaggctcccaagacctcctcataccaanaattatacttactaacgaggggcccgcgggcactcccagactaggttcaggtggcaggtgggtctgggacagaacttcacttcacacatcagcagactggacgcctagaagtatttagactaagttgttaattacttgtacaagtactaaatactacgaccttacccaacccccgtataccctaccgttccggacctaacgggaccacgactcgacagtacgtaagaaacacgtggtacgctaggaccaccgtacttctcgtcttacc

SEQ ID NO: 175066 - DNA, 752 bp, Homo sapiens
  misc_feature: GYAE6OF02IKQ5B.21.33.C11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagagtgagctcgttggggtttgggggggagaagagctgctcagtcaggaccagagggaaccatggaaaccccagcgcagctttctcttcctcctgctactctggctcccagaaaccaccggagagattgtgttgacgcagtctccaggccaccctgtctttgtctcgaggggacaggacnccacctctccgtgcgggccagtcaaagttgttacccgcgtactacttagcctggtaccagcaacgaaacctcggaccacggcctcccagcctcctcactcccaacaatattacttctaccgacgggcccgcgggacactccgagactaggttcaggtcggcgtaggtcggggtacgtacgggactacgggtaccttcgaaccttcctacgacctaagtcacggcaacggtacgtacgggaacgtccgtaggtaaacgttacgttttaggaaccgttaaagtttaacggtttactttaaccgttacggttaaccgtaaaccgtacgttaaaacttacttaaccgggtccctaaccccgtaacccccccgttaacgttccccgtaaaccccggttccgggtaaaccccggaaacgggtaaaccccgaaaccggtacgtccgggacctaaggtaaccggttaaacggtaaaccgtaacggttaccgggttacgaccggtccgaaccgtaccgttacggtacctttaccggttacttacccgg

SEQ ID NO: 175067 - DNA, 798 bp, Homo sapiens
  misc_feature: GYAE6OF02ICMP8.21.33.C11.1.454.CMB.1.raw
tcagtcgtcgctcgcacgaccggtgctcgatttagagtgagctcgttgggtttggggggagaagagctgctcagtcaggaccagagggaaccatggaaaccccagcgcagcttctcttcctcctgctactctggctcccaagaaaccaccggagagattgtgttgacgcagtctccaggcacctgtctttgtctcgaggggacagagactaccctctccgtggccggggccaggtacctaaacgtttcgttaacccgcgtaacttacgttacgccgtcggtaccagcaacggtaaacctggaccacggcctacccgaagacctcctacatacccaactaattacttattccgtaacgacggggcccgtcgggcaacgtcccaagacgtagggttcaggtcggctaggtcgggttcgaggggaacctaggtaccttacgaccctttcgaccaacctacgtcgaagtcgaacggtacgtcgggaccgtccgttaaaggaaactttacgttttacgaacgttaaagtttcgtttaaacgtttaccgttcggttacgtaaacgactttaaaactagtacccggtacccttaacccccggtaaccccctagtttaccccgttaacccggttacccgggaaacccgtaaacgggggtaaacccctaaccgggtaaccgttacggaccgttaacggtaaccggttaaaaccggtaaaacccggtagttaaccgggttaccgggaaccttaccgggtaaccccaaaccgttaccggtttacccgtttaacgttcccgttttaaccc

SEQ ID NO: 175068 - DNA, 523 bp, Homo sapiens
  misc_feature: GYAE6OF02FIZ4Q.21.33.C11.1.454.CMB.1.raw
  modified_base (389)..(389): a, c, t, g, unknown or other
  misc_feature (389)..(389): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgccggggccagtcaaattgtacccgcgactacttagcctggtaccagcagaaacctggccaggctcccagactcctcatccacaatatatctacaggccgcggcatcccagacaggttcagtgcagtgggtctgggacagacttcactctcaccatcagcagactggancctagaagtatttgactaatgtatttactgtcagcaatatgctccaccccatccaccttccgaccgaacggacacgacgtgcgagagtacgaaacgaactgtacggctcgaccgaacctctacttcgtcttacc

SEQ ID NO: 175069 - DNA, 525 bp, Homo sapiens
  misc_feature: GYAE6OF02G1TET.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcactcccagacaggttcagtggcaggtgggtctggggacagacttcactctcaccatcagcagactggagcctagaagtatttgactaatgtattactgtcagctaatatcgctaccaccccgtataccaccttcggaccgaaggacacgactgcagatagaaacaacgtgtcggtctcgaccaccgatcgtgtcttac

SEQ ID NO: 175070 - DNA, 571 bp, Homo sapiens
  misc_feature: GYAE6OF02G56ZZ.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggcctcccagactcctcatcccacaatatttatctacaggggccgcgggcatcccagacaggttcagtggcaggtgggtctgggacagacttcactctcaccatcagcagactggacgcctgaagtatttgactaatgttattacttgtctagactaatactcgtcctaccacccccgatacctaccgttaccgggaccgaaacgggaccaaccgtactcgacgaacgtacgtacgaaacgtaacgtcggtacgtcgtacgacctaaccgtataccgttcgttacttaccg

SEQ ID NO: 175071 - DNA, 633 bp, Homo sapiens
  misc_feature: GYAE6OF02GUYF5.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgccggggccagtcaaattcgttaacccgcgactacttacgcctggtaccagcagaaacctggccaggcctcccagacctcctcactccaacaatatacttctaaccgagggtccgcgggcactccagacaggttcagtgcgtaggtggtcagggacaggtacttcgactctacacatcagcagacgtggacgcctagaaagtattttgactaagttacgttaattacgttagtctaagtactaaattactaccgtccctacccctaacccgtacctaccgttacccgttaccggaaccggtaaacggacctaaccgtacgtacggacgaacggtacgtaaacggaaaccgttacggtacggttacgtacggtaccggtaccgtaaccgtacgtttacgttccgtaccttaccg

SEQ ID NO: 175072 - DNA, 597 bp, Homo sapiens
  misc_feature: GYAE6OF02GS4CO.21.33.C11.1.454.CMB.1.raw
  modified_base (302)..(302): a, c, t, g, unknown or other
  misc_feature (302)..(302): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctccagactcctcatccanaatatattctacagggccgcgggcactcccagacaggttcagtggcaggtgggtctgggacagacttcactctcgaccatcacgcagactcggacgctagaagtacttttgactaaagtcgttaattacgttcgtacgagactaagtactacgcctacccgtacccccgactccgtaccgttccggacccgaaacgggtaccacgtacgtacgacgaagtacgtaacggaaacgtaacgttacggtacggtaccgtacgaccgtaacccgtatttccgttacgttcctttacccg

SEQ ID NO: 175073 - DNA, 568 bp, Homo sapiens
  misc_feature: GYAE6OF02HXUL4.21.33.C11.1.454.CMB.1.raw
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctggcgggccagtcaaattcgttacccgcgactacttagcctggtaccagcaagaaacctggccaggcctcccagacctcctacactaccactaaattatacttcaacgacggggcccgcgggccactcccagactagggttcaggtggactaggtgggtctcgggacagtacttcactctcaaccatcagcagacnggacgcctagaagtatttcgatagtnttattacgtcgtanacgactaatatcgtactacccaaccccgtactacctaccgttccgaccgtaacgggacacgactgacagagtacgaacgtagtcgagcgtacgcctaccatcttgtcttac

SEQ ID NO: 175074 - DNA, 688 bp, Homo sapiens
  misc_feature: GYAE6OF02H5KYX.21.33.C11.1.454.CMB.1.raw
tcagtcgtcgctcgcacgaccggtgctcgatttagagtgagctcgttgggtttggggagagaagagctgctcagtcaggacccagagggaaccatggaaacccagcgcagcttctcttcctcctgctactctggctcccagaaaccaccggagagattgtgttgacgcagtctccaggcacctgtctttgtctcgagggacagacgccaccctctccgtggccgggccagtcaaattcgttacccgcgacttacttagccgtaggtaaccagacaacgaaaccgtggaccacggcctaccccaagtacctcctacactccaactaaattattacttacctaacgacgggcccggcgggccactcccgagacgtacggttcaggtcggctagggtggtcgtaggggactaaggtcttacgctcctacgacctataccgacgactaagacgtacggacgtccgtaggaaacgttgtttacgactaagttacggttaactttacgtacgtactagtaactaattacgtacctacccgtaccccgaaccccgtacgtccttaaccccgttaccggaaccggtaaaccgggaacctaaccggtacctacggtaccgtaaggtaaacgtaaccggaaacgtaaccgttcggtacgggccttacgacccttaccgtacgtttccgtacgtttacc

SEQ ID NO: 175075 - DNA, 594 bp, Homo sapiens
  misc_feature: GYAE6OF02FF21A.21.33.C11.1.454.CMB.1.raw
  modified_base (380)..(380): a, c, t, g, unknown or other
  misc_feature (380)..(380): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggcagagccaccctctcctgccggggccagtcaaattcgtacccgcgactacttagcctggtaccagcagaacctgccaggctccagacctcctcactccacaatatattctacgaggccgcgggcactcccagacaggttcagtggcaggtgggtctgggacagacttcactctcacntcagcagactggactctagaagtatttgactaatgtattacgtgtacaagtactaatagtcgcccttaccccacccccgttatacccgtacccgtttaccggaaccgaaacggacctacgacctacgaccgagtaacgtaacggaaaccggtacgttacggtaccggtaccacggtacccgtaacccgtacttccgttacgttcctttaacccg

SEQ ID NO: 175076 - DNA, 571 bp, Homo sapiens
  misc_feature: GYAE6OF02JDH2X.21.33.C11.1.454.CMB.1.raw
  modified_base (463)..(463): a, c, t, g, unknown or other
  misc_feature (463)..(463): n is a, c, g, or t
tcagtcgtcgctcgcacgaccggtgctcgatttagagtgagctcgttgggtttgggggaggaagagctgctcagtcaggacccagagggaaccatggaaaccccagcgcagcttctcttcctcctgctactctggctcccagaaaccacggagagattgtgttgacgcagtctccaggcaccctgtctttgtctcagggacagacgccacctctcctgcgggccagtcaaattcgtacccgcgactacttagcctggtaccagcagaaacctggaccaggcctcccagactcctcactccacaatatacttctacgaggccgcgggcactccagacaggttcagtcggcaggtgggtcgtagggacacggtactctactcgtacacctatcagtacagtacgtaggacgtaccgtagaacgtatttacgactagtacgttattacgtgtacgagactaatacngtactacccaccccgtatccgtaccttcgaccgtaacggacacgtactcgacagacgtaacgaacgtacgtagttacggacttcgaccacgtactacgtcgtataccg

SEQ ID NO: 175077 - DNA, 623 bp, Homo sapiens
  misc_feature: GYAE6OF02FSJW7.21.33.C11.1.454.CMB.1.raw
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaacctggccaggctccagacctcctcatccacaatatattctacgacgggccgcgggcactcccagactaggttccagtggcaggtgggtctgggacagtcttcactcncacntcagacagacgtggacgtccgtagtaacgtagttttcgactaagtcgttaacttacgttcgtactagtacctaaattactacgtaccttaccccgacccccggtaacttaccctaccggtttaccgaacccgtaaacgggacctaaccgtaccgtccggacgacggtaacgttaacggaaaaccgtacgttacggtcggtacgtacggcctaacctaacgttcgttacgttaccgttaccg

SEQ ID NO: 175078 - DNA, 670 bp, Homo sapiens
  misc_feature: GYAE6OF02H2HXF.21.33.C11.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcacctgtctttgtctccgagggacagagccacctctctggcggggccagtcaaattgtacccgcgactactagcctggtaccagcaagaacctggccaggctcccagactcctcatccaanaatatacttctaacgacgggccgcgggcactccaagactacgggttcacggtggactaggtcggggttactggggacaggtacttcacctctacacccatccagtcgaacgtacgtacggacgtaccgtaggaaaggttacttttagacctaagttcgtttaactttaacgttacggttacgtaacgacttaaacgtacttcgtacccgttacccgtaaccccccgtacttacccgtaacccgttcccgggaacccggtaaaccggggaaccgtaaccggtaccgtacgacgtaacgtaacgtaacggtaaaccgttaacgtacggttacggcgtacgacctaaccgtacgttcttacggttccttaccg

SEQ ID NO: 175079 - DNA, 812 bp, Homo sapiens
  misc_feature: GYAE6OF02IIXN0.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctccagaaaccaccggagagattgtgttgacgcagtctcaggcacctgtctttgctccgaggggacagacgccacctctcgtgcgggcagtctaaagttcgtaccgcgaacttacttacgcctagggtaccagacaacggaaacctcggacctaagggccctacccgaacggaccttcccctacaaccttacccaactaaatttaactacttttaccaaccgtaacggggcccggaaccggggacctaactccccgaaacgtaccgtacgggtttacaacgggtcggtaccaggtcgggtcgtacggggacaaggtaccttcaacgttcctacgaacctatacgacgtcgtaacggaccgtacgggacgtaccgtaggaacgtttacttttaggaccttaaagtttacggttaaactttaccgtacggtttaacgttaaagttaaacgtttaaccgtacggtttacccgtaccccgtaaaccccccgttacgtttaccccgtaacccgggtttacccgggaaccggttaaaaccgggaacccgtaacggtaaccgttacgggaaccctaaggtaaaccgtaacgggtaaaaccggttaaccgtacgggtaaccggtactacggtaaccccgtacttacccggttacgtttaccggttacccttacgtttaaccccgg

SEQ ID NO: 175080 - DNA, 588 bp, Homo sapiens
  misc_feature: GYAE6OF02GQR3A.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggccaccctgtctttgtctccgaggggacagacgcccaccctctcctggccggggccagtcaaattgttacccgcgactacttagcctaggtaccagcagaaacctggccaggcctcccagactcctacactcccaacaatatacttcgtacgacgggccgcgggcactcccagacacggttcagtggctaggtgggtctagggacagtacttcactcgtaccacatccgagcgacgactaggacgtaccaggtaacgtatttcgactaagtgttattacgtgtacagctaatatcgtaccttcccgacccgtatccctaccgttacgaccgtaacggctaacgactcgacgagtaacgtacgaaactacgtcgtacgacgtcgacctacactcgttacgtacttacccg

SEQ ID NO: 175081 - DNA, 615 bp, Homo sapiens
  misc_feature: GYAE6OF02FNHZK.21.33.C11.1.454.CMB.1.raw
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgccggggccagtcaaattcgtacccgcgactacttagcctgtaccagcagaaacctgccaggctccanacctcctcactccacaatatattctacgacgggccgngggcactcccagacaggttcagtggcaggtgggtctgggcagtacttcactctcaccatcagacagacgtggacgcgtacggaaagttcttttagactaagttacgttatttacgtcgttacacgtactaaattactcgccttacccgaacccccgtactacccgtacccgttaccggaaccgtaacgggaccctaaccgtaacgtacggccgtaagtaacgtaacggtaaaaccggaaccttggtaccggtaacgtcgaaccaccgtattaccgtacgttccttaccg

SEQ ID NO: 175082 - DNA, 637 bp, Homo sapiens
  misc_feature: GYAE6OF02GOGKD.21.33.C11.1.454.CMB.1.raw
  modified_base (327)..(327): a, c, t, g, unknown or other
  misc_feature (327)..(327): n is a, c, g, or t
  modified_base (409)..(409): a, c, t, g, unknown or other
  misc_feature (409)..(409): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctcaggggacagagccaccctctcctgcggggccagtcaaattgttacccgcgactactagcctggtaccagcagaaacctggccaggcctcccagacctcctcactccacaatatattctacgacgggcccgngggccatcccagactacggttcagtggacgtaggtggggtcgtaggggaccaaggtacttcgaccttcctcaaccatacgancgaacgtacgtacgggacgtcccgttaggaaacgtagttttacgtactaaagttgttaactttacgttagttacctaggtacctaaagttactacggtcctaacccgaacccccgtacttacccgtaccgtttccggaccgtaaacgggacctaacgaccctgacaggaactacggaaacgtacgtaggtcggtagttccgacgtaccgtattcgtacgttcttaccg

SEQ ID NO: 175083 - DNA, 612 bp, Homo sapiens
  misc_feature: GYAE6OF02IT6WG.21.33.C11.1.454.CMB.1.raw
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccaccctctcctgcgggccagtcaaattcgtaccgcgactacttagcctggtaccagcagaaacctggccaggctcccagactcctcactccaacaatatattctacgacgggccgcgggcatcccagaccnggttcagtcgacaggtgggtctgggacaggtacttcactcncaccatcagcagacgtggacgccgtagtaacgtatttagactaacgttgttacgttacgttcgtactacgtactaagtatccggacctacccgaacccccgtactacccgtacccgttccggaccgtaaacggaccgaaccgtacgtacgtacgacgtacgtaacggaaaccgtacgttacggtaccgtacgtacgaccgtacctacgttacgttaccgttccttaccg

SEQ ID NO: 175084 - DNA, 684 bp, Homo sapiens
  misc_feature: GYAE6OF02F7E4D.21.33.C11.1.454.CMB.1.raw
tcagtcgtcgctcgcacgaccggtgctcgatttagagtgagctcgttgggtttgggggggagaagagctgctcagtcaggacccaggaagggaaccatacggaaaccccagcgcagcttctcttcctcctgctactctggcctcccaacgaaacccaccggagagtattgtgttgaccgcagtctccgaggccaccctgttctttgtcctccgaggggacagacgcccaccctctcctgggccggggccagtactaaatttcggtaccccgcgtaacttacgttcgcctaggtaccagcaacgaaaccgtcggaccaggcctaccgagacctcctcactacccacaatactattactacgacgggccggcgggactacgtacccgagacgtaggttctaggtcggcgaggttcgggtcgtagggacctagtaccttcactcctaccaacctatacgagacagtacgtacggacgtcctaggaacttagtttgaactaattgttaactttacgttacgtacgtacgactaattacgtcgacctaccccggtaaccccgtacttccgtacccggttacccgaaacggtaacggacccgaacgtaccgtcggaccgaagtacgtaacggtaaacctacgttcgggtacgtaccgtcgaccgtaacctacgtcttacgttaccttacc

SEQ ID NO: 175085 - DNA, 549 bp, Homo sapiens
  misc_feature: GYAE6OF02G55HW.21.33.C11.1.454.CMB.1.raw
tcagtcgtcgctcgcacgaccggtgctcgatttagagtgagctcgttgggtttggggggagaagagctgctcagtcaggacccagagggaaccgtggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggctccagactcctcatccacaatatattctacgagggccgcgggacatcccagacaggttcagtgcaggtggtctgggacagactttcactctacactatcagcagactggacgcctagaagtatttagactaattagtaattacgtagttacagactaatatagcctaccaccccgtatacctaccgttccgaccgaaggaccacgactgacagacgtagaaacgtactaggtacgtcgtacgactacctatacctcgtactactac

SEQ ID NO: 175086 - DNA, 647 bp, Homo sapiens
  misc_feature: GYAE6OF02FZ771.21.33.C11.1.454.CMB.1.raw
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgcttactctggctcccagaaaccaccggagagattgtgttgacgcagtctccaggccaccctgtctttgtctccgaggggacagacgccaccctctcctggccggggccagtcaaattcgtacccgcgtactacttagcctggtaccagcaagaaacctggccaggcctccagacctcctnactccaacaatatattctacgacgggccgcgggcacgtcccagacctagggttccagtggcaggtcgggtctgggacagtcttcactctcactancacgacagtacttgggacgtcccgtagtaagttagtttacgactaattggttaacttacgtcgtactacgtactaaattatcgtaccttaccccgaaccccctagtcccgttacccgttaccgggaacccgtaaacgggacccgtaccgtaacgttccgacgtaaggtaacgtaaccggaaaccgttaacgtcgggtacgtacgtcggaccctaacccgtactccgtttacgtacctttacccgg

SEQ ID NO: 175087 - DNA, 746 bp, Homo sapiens
  misc_feature: GYAE6OF02JTJIA.21.33.C11.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagcccaccctctcctggcggggccagtcaaattcgttacccgngaccttacttagcctggtaccagcagaaacctcggccaggcctccccagaccttcctcactcccaactaaactacttattacgtaacgcggggtacccgccggggctaacttccccgaagtaacccgtaagggtttcaaggttcgggactaggttggggtacttaggaacgacacggtaaccttttacacttacctaccaaccctagtaccgaacgtccgaacgacgttacgggacctaccgttacggtaaagttaacgtttttacggaacctttaaaggttacggttaaacttttaccgtagttaccgtaacgtaacctaaagttagttaccgtaccctacccctaaccccccgtacttacccgtacccggtttaccgggaccgaaaaccgggacctaacgtaccgtcgtaaccgacggtaacggtaaccgtaaaacggtaaccgttggttaacggccttaacggaccctaaccggtacttccgttacgttaccg

SEQ ID NO: 175088 - DNA, 684 bp, Homo sapiens
  misc_feature: GYAE6OF02HTTT0.21.33.C11.1.454.CMB.1.raw
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
tcagtcgtcgctcgcacgaccggtgctcgatttagagtgagctcgttgggtttggggggtaggaaggaggctgctcagtcaggacccagagggaaccatggaaaccccagcgcagcttctcttcctcctgctactctggctcccagaaccaccggagagattgtgttgacgcagtctcaggcacctgtctttgctccaggggaccagacgccacccgtctccgtgcggggccagtcaaagttgtacccgcgactacttacgcctggtaccagctaagaaacctggccaggctacccagactcctcatccacaanatagttcacaggccncggcactccanacgaggttcaggtgctagtgggtctgggacagtctcactcctacacctatnacgcagtacgtaggaccgtacctaggaagttacgtttacgaacgtaacgttaggttaactttacgtacggttaccaaggttacctaaaagttagttaccgaccttaccccgaaacccccccggtactaccccgttaaccccggtttacccgtaacccggtaaaccggggaacccttaaaccggaaccgttgacccggtaacggtaccgtaaacggtaaaaccggtacgtaaccggttacgggccgttacggtaacccgacctttaaccgtcgtttaccgtaccggttttaccc

SEQ ID NO: 175089 - DNA, 528 bp, Homo sapiens
  misc_feature: GYAE6OF02JHGXL.21.33.C11.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattgttacccgcgactacttagcctggtaccagcagaaacctggccaggctcccagactcctcactccacaatatattctacagggccgcgggcactcccagacnggttcagtggcagtggtctgggacagacttcgactctcaccatcagcagactggagcctgaagtattttgctaatgttattactgtcagcaatatcgcttccacccccgtatcctaccttcggacccaacgggaccacgactcgacagagtacgaaacgaactgtaggctcgacaccatctcgtcttacg

SEQ ID NO: 175090 - DNA, 843 bp, Homo sapiens
  misc_feature: GYAE6OF02GYFBG.21.33.C11.1.454.CMB.1.raw
  modified_base (153)..(153): a, c, t, g, unknown or other
  misc_feature (153)..(153): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (420)..(420): a, c, t, g, unknown or other
  misc_feature (420)..(420): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccgganagattgtgttgacgcagtctccgaggcacctgtctttgctccgagggcagacgccaccctctccgtgccggggaccagtctaaattcggtacccgcgtactacttacgcctggtaccagcagaacctggccaggcctccagcctccncactaccanaatattactactacgagggccgcggactacgtcccaagaccgtaggttccaggtcggaccgtaggtcgggtacggtgggaccaggtaccttcgaacttctaccaacccgtntaccgacaccgtaacggtaccgtacggtaaccgtaccgtaaggtaaacgttacggttttacgaacgttaaacggtttacggttaacgtttaacgttacggttacgtaaccggttaaccgttaaacgtttaacgtccgtaaccctttacccccggaaccccccggttaacgttaccccggttaaaccccggtttaacccgggtaaaccccggttaaaaccggggtaaccccgttaaaccgggtaccccgttaacgggtaaccccggtaaacggttaaccccggttaaaaccgggttaaaaaccccggttaaacgggtttacccgggtaaccgggttaacccggtttacccggtaaccccggttaaaccccggttacccgtttaaccccgggttttacccgttttaaccccggttttaaccccgg

SEQ ID NO: 175091 - DNA, 547 bp, Homo sapiens
  misc_feature: GYAE6OF02G152A.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgtacccgcgactacttagcctggtaccagcagaaacctggccaggctcccagacctcctcactccactaatatattctacgacgggccgcgggcactcccagacaggttcagtggcagtgggtctgggacaggacttcactctcactatcagcagtacgtggacgctagaagtatttcgactaattgtattacttgtctagctaatatgcctccacccccgtatcctaccgttccggccgaacgggacacgacgtagcagacgtacgaacgtacgtacgtgcgtcgaccacctattcgtcgttacttac

SEQ ID NO: 175092 - DNA, 605 bp, Homo sapiens
  misc_feature: GYAE6OF02FJ8ZV.21.33.C11.1.454.CMB.1.raw
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccaccctctccgtgccggggccagtcaaattcgttacccgngacctacttagccttggtacccagcacgaaacctggccaggcctcccagtctccncatctagtgggcacttcctacaggatcgaccggcactacccagacaggttcagtgccgaggtggtcgtgggacagtacttcactctcacatacaacncactggcctctagaagttatttgctagtntatttacgtgtacgagtcgagtacgtacggtaattccgaaccttcgttcgttccggttacggaccgtaaacgggaaccgtaaagggtaacgtaagtacggtaaaccgtagtcggtacggtacgtaccgaaccgaccgtacgtaccgttcgttaccttctacgttcccttacccg

SEQ ID NO: 175093 - DNA, 652 bp, Homo sapiens
  misc_feature: GYAE6OF02HRRIS.21.33.C11.1.454.CMB.1.raw
  modified_base (300)..(300): a, c, t, g, unknown or other
  misc_feature (300)..(300): n is a, c, g, or t
  modified_base (647)..(647): a, c, t, g, unknown or other
  misc_feature (647)..(647): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacagacgccacctctcctgcgggccagtcaaattcgtacccgcgactacgttagcctggtaccagtcacgaaacctggccaggtcctccgagacctccnctactcccaactaactatacttacaacgacggggcccgtaggggccaacgttccccgaagaccgtacgggttaccaggtcggacctaggttcggggtccgtagggacctacggtaccttcacgttcctacaacctagtaccaggaccagtaccgtaggacgtccgtaggaacgttattttacggactaagttacgtatttacgtacgtcgtaacgtcgtaaattactacgcctacccgtaaccccgtactaccgtacccgttacggacccgtaagggtaccacgtacctgacctaagacgtaacggaacgtaacgtcggtagtcgtacacgtacctatcgtacgttnttacc

SEQ ID NO: 175094 - DNA, 683 bp, Homo sapiens
  misc_feature: GYAE6OF02HKTDM.21.33.C11.1.454.CMB.1.raw
  modified_base (393)..(393): a, c, t, g, unknown or other
  misc_feature (393)..(393): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaaccaccggagagattgtgttgacgcagtctccaggcaccctgttctttgtctccgagggacagacgcccaccctctccgtggccgggaccagtacaaagttcgtacccgcgtactacgttagcctggtaccagcaagaacctggccacggcctacccagactcctcactccaactaattatacttaccgtaacgacgggcccgcggctactcccgaagaccgtaggttcaggtcggacgaggtgggtcgngggacaggtaccttcgactctaccaacctagtccgacgcgtaacgtacgtcggtaacgtccgtaaggtaacgtttagttttacgaacgtaaagtttagttactttacgtcgtactaagtacctaagtacgtaccgttacccgtaccccaaccccccgttataccctacccggttacggaacccgtaacggtaccgtaccgtaccgtaccgacgtaacgacgtaacgaaccggtaagtcggttaccggcttaccggaacctaccgtagttaccgttcgttacccgttaccg

SEQ ID NO: 175095 - DNA, 569 bp, Homo sapiens
  misc_feature: GYAE6OF02GV4O7.21.33.C11.1.454.CMB.1.raw
  modified_base (246)..(246): a, c, t, g, unknown or other
  misc_feature (246)..(246): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (488)..(488): a, c, t, g, unknown or other
  misc_feature (488)..(488): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccccgtctttgtctccaggggacagagccaccctctcctgcgggccagtcaaattcgttacccgngactacttagcctggtaccagcagaaacctggccaggcctccagactcctcatccacaatatattctacacgggccgcgggcatcccagacaggttcagtggcaggtggtctgggacagactttcgactctacactatcagcagactggancctgaatntttgactaatgtaacttactgtacngactaatancgtcacccaccccgatccgtaccttccggacctaacgggaccacgtacncgtacacgtaacgtacgaaacgtactcggtacgtacgtacgaccctacgtaacgtccgtttacggttacctacgttacccg

SEQ ID NO: 175096 - DNA, 558 bp, Homo sapiens
  misc_feature: GYAE6OF02HZ9M9.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctggcgggccagtcaaattgtacccgcgactacttagcctggtaccagcagaaacctggccaggcctcccagactcctcactcccacaatatacttctacagggcccgcggcactcccagacaggttcagtggcagtgggtctgggacagtacttcactctacaccatcagcagacgtggacgccgtagtaagtatttcgactaatagttattactgtactagtacaatatcgtctacccgacccccgtataccctaccgtaccgaccgaacgggaaccacgactcgacagagtaacgaaaccgtagtacgtagtctacgctaccgacgtctcgtctac

SEQ ID NO: 175097 - DNA, 629 bp, Homo sapiens
  misc_feature: GYAE6OF02JKQ19.21.33.C11.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtgagctcgttgggtttggggggagggaagagctgctcagtcaggacccagacgggaaccatggaaaccccagcgcagcttctcttcctcctgctactctggctccagaaaccaccggagagattcgtgttgacgcagtctccaggcaccctgtctttgtctcgagggccagacgccaccctctccngcgggccagtcaattcgtaccgcgactactgctgtacancagaactcggcacgctccagcctcncactcctactatatatctacacggcgacggcactcccagacgtgttcgagtcgctacggtggtacgtacggactagacgttaccacgtctccactnctacgcacgcgacggacnccgtagaaggttatttcggaacgtaacttgtaactttacgtacgtacgagacgtaattagcttctaacccgtaccccgtacgtaccgtaccggtacggaccgtaagggaacccgtcgtaacgccgtacgtaaggacgtaacccgggaaaacgtacggttcccggtacggtaccccgtacggttaccctaccccgtacgttaccccggttccgtttacccgttaacccg

SEQ ID NO: 175098 - DNA, 700 bp, Homo sapiens
  misc_feature: GYAE6OF02I6WTM.21.33.C11.1.454.CMB.1.raw
tcagtcgtcgctcgcacgaccggtgctcgatttagagtgagctcgttgggtttgggggagaagagctgctcagtcaggacccagaggaaccatggaaacccagcgcagcttctcttcctcctgctactctggctccaagaaccaccggagagattgtgttgacgcagtctccagcacctgtctttgtctccaggggacagacgcctaccctctccgtgcgggaccacgtacaaaagttcgtaacccgtcgaacttacttacgcctggtaccagctaacgaaaccgtggccaacggtccacccggaatacctccttacaactaccaacaatatacttactacgaacgggcgacgggtaccacgtaaccacgacgtacggttacaacggtcggactacggttcgggtacttaggggactaacggtaacttcgaaccttactaccgaacccttaggtaaccacggtacaacggtacgtcggactaccgtagaaggtactttgaattaatacgttacgtaacttcgagaactacaactaacgtcgaacctacccgtaaccccgtattaccgtaaccgttacggaaccgtaacgggaacctaacgggtaaccgttagaccgaagaacggtaacggtaaacgtaccggtaaggttacgaccgtacgtaccgtaacccttagggtaaccttcggtaccctttaaccg

SEQ ID NO: 175099 - DNA, 740 bp, Homo sapiens
  misc_feature: GYAE6OF02HBX23.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctggcgggccagtcaaattcgtaccgcgactactagcctggtaccagcagaaacctcggccaggcctacccagacctccctacactcccaactaaattactactttactaccgaggggcccgacgggcactacccgagaccgtaggttccaggtcggcgaggttcggggtcgtaggggacacgtactttccaacttccgaacctaacccgtattacccgacgacgtaacgaccgttcgggaacgtacccgtaaggtaaaggttacgttttagacgttaaagtttacggttaaactttaacgttacggttacctaacggtaaccttaaaagtttacgtaccggtacccttacccccggtaacccccccgtaacgttaccccgttaacccgtttacccgggtaacccgtaaaaccggggaaccctaaccggtacgtacgaccgtacggtaacgtaacggaaaccgtaacgtcggtacggtacgtacgaaccgtaccgtacgttacgttaccgttacttacccg

SEQ ID NO: 175100 - DNA, 747 bp, Homo sapiens
  misc_feature: GYAE6OF02GXAC2.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgcccaccctctcctgcgggccagtcaaattcgtacccgcgactacttacgcctggtaccagcagaaacctggccaggctccagactcctcactccacaatatattctacgacggccgcacggcactcccaagacaggttcgagtggcaggtcggtcgtcggggacacggtacttacactcgtttaccaaccgtactccgaacgcgtagaaccgttgggacgtacccgtaaggtaaacggttaacttttacggacctaaagttacgtttaaacgtttaaccgttagttaaccgtaacggtaaccttaaacgttaacgttaacggtacccttaaccccgtaaacccccccgggtacttaaccccgttaaccccggtttacccgggtaaacccggtaaaaccgggtaacccgtaaaccggttaacccgtcggtaaaccggtaacggtaaaccgtaacgggtaaaaaccggttaaccgttacgggttacggtacccgttacggaacccgttaacccgaacgtttaccgtaccgttttaaccccg

SEQ ID NO: 175101 - DNA, 644 bp, Homo sapiens
  misc_feature: GYAE6OF02HG2JG.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagcccacctctcctggcgggccagtcaaattcgtacccgcgactactagctaggtaccagcagtaaaacctggaccaggcctacccagacctacctcatacccaataaactattaacttctaacgacgggcccgacgggcactcccagaacctaggttcaggtcggcaggtgggtacttacgggacaacgtacttacactctacaaccatacacgcagactaggagcctagtaaacgttatttacgactaaattcgttaagttacttgtaccaaggtacaaattacgtacgtaccttaccccgaaacccccgtattaccctacccggtttacggaacccgtaaacggggaacaaccgtaccgtagacgaagaacggtaacgaaacgtaactggtacgacgtacggtaccaacctacgtacgttacgttacgtttacc

SEQ ID NO: 175102 - DNA, 815 bp, Homo sapiens
  misc_feature: GYAE6OF02H4JUI.21.33.C11.1.454.CMB.1.raw
tcagtcgtcgctcgcacgaccggtgctcgatttagagtgagctcggttgggtttggggggagaagagctgctcagtcaggaccagagggaaccatggaaaccccagcgcagcttctcttcctcctgctactctggctcccagaaccaccggagagattgtgtgacgcagtctccaggcacctgtcttgtctccgagggacagacgccaccctctcctggcgggccagtacaaattcgtacccgcgactacttacgcctcggtacagcaacgaaaccgtggaccacggcctcccgagtacctcctacactaccaacaattaattacttaccaacgacgggtccggacggcaccgtccgaagtacgtacggttcacggtcggtacgtacgggtcgggttacggtacggggaactaacggtacctttccgtaaccttcccgtacctaacccgtacgttacccggaacggtaccgtaacgggtaaccggttacggggtaaccggtacccggttaagggttaaacggttaacgtttttacggaaccgttaaagttacggtttaaacgtttaccgttaggtacctaacgttaacctaaagttacgtaccgtaccctaaccccgtaacccccgttacttaccccgtaacccggtttacccgggaaacccgtaaaccggggaacctaaacccgggtaccttaccggaaccgtaacgggtaacggtaaaccggtaaaaccggttaaccggtaacgggttaccggtacccgtttacggaaccccgtaaccgttaaccggttcccgtttacgttacccgttacccg

SEQ ID NO: 175103 - DNA, 806 bp, Homo sapiens
  misc_feature: GYAE6OF02FHFTY.21.33.C11.1.454.CMB.1.raw
  modified_base (152)..(152): a, c, t, g, unknown or other
  misc_feature (152)..(152): n is a, c, g, or t
tcagtcgtcgctcgcacgaccggtgctcgatttagagtgagctcgttgggtttggggggagaagagctgctcagtcaggacccagagggaaccatggaaccccagcgcagcttctcttcctcctgctactctgcctcccagaaccaccgganagattgtgttgacgcagtctccaggccaccctgtctttgacctccgaggggacagcgtcccacccgtcctcctcgggccggggacctaggtacctaaacgtttccggttaaccccgcgtaccgttaaccgttacgcccgttcgggtacccaggacctaacgaaaccctcggaccccaggtcccctacccgacgacctcccctacgactccctaacctaacttagtaccttcgtaacggtacgggccgaccgggtccactaccccgaagtaacccgtaggttaccgaggttcgggtacgtacggtcggggttaccgtacggggaccgtaacggtaaccctttacccgaccgttccctaaccaaccctacgttacggaaccacgtaccgtaaccggttcggaccgtaccgtaaggtaaacgttactttacggaacttaattacgtaacctttacgtaccggtacctaagtaacccgtaagtttacccgttccgtaaccccgttaccccccggtaacccccgtagtttacccccgtaacgggttaaccccgtaccgggaacgtaccgacctacgtacgaccgtagtaaccggtaacgaacggtaccgttaggaccgacgttacgaccgtaccctagttcccgttacttacctacccg

SEQ ID NO: 175104 - DNA, 735 bp, Homo sapiens
  misc_feature: GYAE6OF02IE2UW.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctcgagcaccctgtctttgctccgagggacagacgccaccctctccgtggcgggccagtacaaagttcgtacccgcgaacttacttacgctggtaccagacaacgaaacctcggaccaggcctacccgagacctcccagtactacccaacaattactactttaccgaacgacgggcccgcgggactactacccaagtactagggttccaaggtcggcgtaaggtcgggtcctaggggtaacacggttaccttacgaccttccgtaaccaaccgtagtccgaacgacctaagtacgtacggacgtccgtaagtaagtagtttacgacttaaagtgttaacttacgtacgtacaaggtacaaagtactacggtacctaccccgtaacccccgtactacccgttacccgtaaccggtaacccgggtaaacgggtaacccgtaacccgtacggttacgtaccgaaacggtaccgtaaacggtaaaaccggttaaacgtcgggtttaacgggacccgttaccgaacccgtaccgttaacgttccggtttaccggttcctttaacccgg

SEQ ID NO: 175105 - DNA, 594 bp, Homo sapiens
  misc_feature: GYAE6OF02H6FG0.21.33.C11.1.454.CMB.1.raw
  modified_base (449)..(449): a, c, t, g, unknown or other
  misc_feature (449)..(449): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctggcggggccagtcaaattcgttacccgcgactacttagcctggtaccagcagaaacctggccaggcctccagacctcctcactccaacaatatacttctacgacgggccgcgggcacgtcccagacaggttacagtggcaggtggggtcgtgggacagtacttcactctacacactacagcagtactggagccgtagaagtatttgataatagttattacttgtacagntaaatatcgacctccccaacccccgtactaccctacccgttaccggacccgtaaacgggaccgaaccgaccgtacgacgaacgaagtaacgaaaccggtaacgtacggtacggctacgacctaccctatccgttcgtactttacc

SEQ ID NO: 175106 - DNA, 780 bp, Homo sapiens
  misc_feature: GYAE6OF02I8PDG.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaacccaccggagagattgtgtgacgcagtctccaggccaccctgtctttgtctccgagggacagacgcccaccctctcctggccgggccagtacaaattcgtacccgcactactagcctggtaccagcaacgaacctggccaggacctcccgagtacctccctacacctacccaactaacttacttaactttccgtaaccggacgggggccccggacgggacctaacctaccccgtaaggaaccgttacgggttccgaagggttcggaccgtagggttcggggggttaccgtacggggaaccctaaggtaacccgtttaccgtaaccgttcctaccaaccccgtacttaccgaacgggtactaaccgggtacgttacggggaccgtacccgttaagggtaaacgtttacgttttacggaaccttaagtttgttaaactttacgtagttacaaccggtattaaacgtcgtacccgtaccctacccccgtaccccgttactcccgtaacccggttaccggaaccgggtaacggaaccgtaccgtaccgtacgacccgtaaggtaaccgtaacgggtaaaccgtccggttgggtacccgtaccgtacgacctaccgttacgttcttaccggtcttaacccg

SEQ ID NO: 175107 - DNA, 602 bp, Homo sapiens
  misc_feature: GYAE6OF02IWW03.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaacccaccggagagattgtgttgacgcagtctccaggcaccctgtctttgtctccaggggacagagcccaccctctcctgcgggccagtcaaattgttacccgcgactacttacgcctggtaccagcagaaacctggccaggcctcccgagactccgtcactccaacaatactattctacacgggccgcgggcactcccagacaggttcagtggcagtgggtctgggacagtacttcactctcacctactcagcagactaggacgctagaatagtttgacgtaatgttaacttacgttgttacagactaaatacgtacgtctaccctacccccgtactaccgtacccgttaccggaccgtaaacgggaccgtaaccgtaccgtacgacaacgtacgtaacgaacgtaacgtcggtacggcgttacgaccgtaaccgtacgttcgttcttacgttacccg

SEQ ID NO: 175108 - DNA, 576 bp, Homo sapiens
  misc_feature: GYAE6OF02I65B3.21.33.C11.1.454.CMB.1.raw
  modified_base (400)..(400): a, c, t, g, unknown or other
  misc_feature (400)..(400): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggcagagccaccctctcctgcggggccagtcaaattgttaccccgcgactacttagcctggtaccagcagaaacctggccaggctccagactcctcatccacaatatattctacacgggccgcgggcactcccagacaggttcagtggcaggtgggtctgggacagacttcactctacaccgatcagcacgactacggancctaggaagtatttcgactaagtgtacttactgtcagtcaatagtgcctcccgacccccgtatacctaccgttaccgaccgtaaacgggaccctaacgacgtacgcacgacgtaacggaaacgtacgtggtacggtaccgtacgtaccaccgtactttaccgtcgttaccttaccg

SEQ ID NO: 175109 - DNA, 534 bp, Homo sapiens
  misc_feature: GYAE6OF02ICREP.21.33.C11.1.454.CMB.1.raw
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtccaaattcgttaacccgcgactacttagcctggtaccagcagaaacctggccaggctcccagactcctcatccacaatatatctacagggccgcggcatcccagacaggttcagtgcagtggtctgggcagacttcacttcnacntcagcagatgganccgtagaagtatttgactaatgttaattacttagtctagacaattatgactcccaaccccgtatcctaccgttcgaccgaaggacaccgactgacagacgtacgaacgacgtagtcgctagcctaactacgtcttagtcttaccg

SEQ ID NO: 175110 - DNA, 798 bp, Homo sapiens
  misc_feature: GYAE6OF02JSMBR.21.33.C11.1.454.CMB.1.raw
  modified_base (558)..(558): a, c, t, g, unknown or other
  misc_feature (558)..(558): n is a, c, g, or t
tcagtcgtcgctcgcacgaccggtgctcgatttagagtgagctcgttgggtttgggggggtaggaagaggctgctcagtcaggacccagagggaaccatggaaaccccagacgcagcttctcttcctcctgctactctggctccagaaaccaccggagagattgtggttgacgcagtctccaggcacctgtcttagtctcagggacagacgccaccctctccgtgccggggaccagtacgtaaattcggtaaccccgcgtaacctacgttacgccgttcgtacctagcaacgaaccgtcggtaccacgggccctacccgacggtacctaccctcgtacctcccgaaacctaactaagttacttaccgtaacgtaccggggaccgtcgggacctaacgtccccgtaacgaacggtacggttacgtaaggtcgggtaacacggttcggggttaacggttcgggaacctaggttacccgtaactaccgtaccgtcccaaaccgtacttaccgaagtccaaacggtccgacggtacacggttacggaaacttaggttttaanaaccgtaattaaccggttaacgttttacgttcgtaaccgtaacggtaccttaaatcgttaaccgacccttaacccgtacccccgtacgtaccgttaacccggtcccggtaaacgaaacccggggtacgtaacccggtaaccgttcgaaccgtaaggtaacccgttaagggaaacccttaggtccgttaaccgggtcctaaacgacccgtaccgttatttaacggccgttaccctttacgg

SEQ ID NO: 175111 - DNA, 686 bp, Homo sapiens
  misc_feature: GYAE6OF02F95MU.21.33.C11.1.454.CMB.1.raw
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaacccaccggagagattgtgttgacgcagtctccaggcaccctgtctttgtctccagggacagagccaccctcncctgcgggccagtcaaattgtacccgngactacttagcctgtaccagcagaaacctggccaggcctaccagactcctcactccacaatatattctacgacgggccgacgggcactcccagaacgtacggttcagtcggacaggttgggtctaggggactagtacttcgactctaccaccagtccgagaccgaacgtacgtacggacgtaccgtaggaacgttacgttttacgaacgtaaagttacgttaacgtttaccgttacggttaccgtaacggtaacgtaaattacgttacgtacccgttaccccgaaccccccgtaacttacccgttaacccgttccgggtaacccgaaccgggtaaccgtaccgtaaccgtacgtaccgaacggtacgtaaccggaaaccgtaacggtacggttacggtacgtacggtaccgacccgtacgttaccgttacgttacctttaccg

SEQ ID NO: 175112 - DNA, 610 bp, Homo sapiens
  misc_feature: GYAE6OF02F5ZJC.21.33.C11.1.454.CMB.1.raw
  modified_base (245)..(245): a, c, t, g, unknown or other
  misc_feature (245)..(245): n is a, c, g, or t
  modified_base (381)..(381): a, c, t, g, unknown or other
  misc_feature (381)..(381): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaagttgtacccgngacttacttagcctggtaccagcagaaacctggccaggctcccagacctcctcatccacaatatattcacgacgggccgcgggcactccagacaggttcagtgcaggtggtctgggacagacttcactctacaccntacagcagacgtagacgcctagaagtatttgactaattgtattactagtacagactaattactacgtaccttacccgaacccccgtattaccccgttaccgttccggaacccgtaaggggaaccctaaccggaccgttacggaccaaggtaaccgttaaggaaaacccgtacggttacggtccgggtactcggtacccaacccgtagtccgtttacgttctttaacccg

SEQ ID NO: 175113 - DNA, 606 bp, Homo sapiens
  misc_feature: GYAE6OF02GJM3S.21.33.C11.1.454.CMB.1.raw
tcagtcgtcgctcgcacgaccggtgctcgatttagagtgagctcgttgggtttgggggggagaagagctgctcagtcagggacccagagggaaccatggaaaccccagcgcagcttctcttcctcctgctactctggctcccagaaaccaccggagagattgtgttgacgcagtctccaggcaccctgtctttgtctccgaggggacagagccaccctctcctgcggggccagtcaaattcgtacccgcgacttacttagcctggtaccagcagaaacctggccaggctcccagactcctacactccacaatatattctacagggccgcgggcacgtcccagacaggttcagtgcaggtgggtctgggacagacttcactctcacatacagcacgacgtggacgcctagaagtatttgactaatagtacttacttgtacagtactaatagtacgtacctaccgaacccccgtactaccgtaacccgttaccggaaccgtaaacgggtaccctaaccgtaaccgttcgaccgaggtaacgtaacggaaaccgtaaccggtcggttacggacgtacgacctaaccgtaccgtcttaccgtcttaaccg

SEQ ID NO: 175114 - DNA, 797 bp, Homo sapiens
  misc_feature: GYAE6OF02GBA44.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtcctccagcaccctgtctttgcctccgagggacagacgccacctcctctggccgggccagtcaaattcgtacccgctactactagtcctggtaccagcaacgtaaccgtcggaccaggcctcccgagtacctcctcactaccaactaataacgttacttccgaaccgtacgggcccggaacggcctaacctaccccgaagaaccgttacgggttccaggtacggggtacctaaggggtttcgggtccgtacgggaaccgtacgtaaccttcccgtacttccgtaacccgaacctaccgttacggtaccgaccgtaaggtaccggtacgggtaaccgtacccgttaacggtaaagtttacgttttaaccgaccgttaacgtttacggttaaaccgttttaccttaacggtacctaacggtaacctaaacgtttaacggtacccggttaacccttccccccgtaaacccccggttccttaaccccgggttaccgttaacccgggtaaccgaacgggtaccctaaccggttaccgacgcgaaaccgtacgtaaacggtaaccgtaaccggtaacggtccggaaccttccggaaccgtaccctgttaccggtttccggttaccttacccg

SEQ ID NO: 175115 - DNA, 637 bp, Homo sapiens
  misc_feature: GYAE6OF02IGE8Y.21.33.C11.1.454.CMB.1.raw
  modified_base (573)..(573): a, c, t, g, unknown or other
  misc_feature (573)..(573): n is a, c, g, or t
  modified_base (620)..(620): a, c, t, g, unknown or other
  misc_feature (620)..(620): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgcccaccctctccgtggccggggccagtacaaattcgttacccgcgactacttacgccgtggtaccagcaacgtaaaccgtggaccaggcctcccaacgaccttccgtacacgttaccaactaatacttacttacctacggaggggcccggcgggcacctcccaacgacgtaggtcagtggcgtaggtcggtacgtgggaacacgtacgttcacgtctccaacctacgtccagacgacgtacgtcggacgaccgtagaaggttatttagactaagttagttacttaacgtacgttacagtactaaattgacgtcccgaccctaaccccgactccctaccgtacggaccgaacggtacaccgtacncgacacggtagtaaacggaactacgtggtacgcgtcgactaaccgtntaccgttcttcttaccg

SEQ ID NO: 175116 - DNA, 694 bp, Homo sapiens
  misc_feature: GYAE6OF02GILFZ.21.33.C11.1.454.CMB.1.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
tcagtcgtcgctcgcacgaccggtgctcgatttagagtgagctcgttgggtttggggggaggaagagctgctcagtcaggacccagagggaaccatggaaacccagcgcagcttctcttcctcctgctactctggctccagaaccaccggagagattgtgttgacgcagtctccaggcaccctgtctttgtctccaggggacagagcccacctctcctggcggggacagtcaaattcgtacccgngtaactacttagccctaggtaccagccaagaaaccctgggccaaggcctcccagacctcctcactccacaaattnagtttcacagggtaccgcgggactactacccagtacgacggttcagtggcctaggtggtcgtgaacgagtactttcgactactcacgtaatcgagtacagtacgtggaacgtcgaagtaagtacgttttcgaacgttaagtacgttaaatttacgttacggtcctaaacgggtacctaaagttaaccgtcttacccggttaaccccaacccccggttataccccgttaaccgtttcccggaaccgtaaacgggaacctaaccgtacgtacgaccgaaaggttaaccaacgggaaaaccgtaaccgttacgggtaccggtacgtttacccggaacctaaacccggtctttaccggttaccggtttatttaacccc

SEQ ID NO: 175117 - DNA, 563 bp, Homo sapiens
  misc_feature: GYAE6OF02G73UI.21.33.C11.1.454.CMB.1.raw
  modified_base (360)..(360): a, c, t, g, unknown or other
  misc_feature (360)..(360): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcgggccagtcaaattgttacccgcgactacttagcctggtaccagcagaaacctggccaggcctccagactcctcactccacaatatattcacgacgggccgcgggcactcccagacaggttcagtggcagtgggtcngggacagtacttcactctcacatcagcagactggacgcctaggaagtatttagactaagttagtattacgtgtacagtacaatactgtcctccaccccgtactccaccgttcggaccgaacggaccacgtactcgacagtacgtaacggaaacgtacgtggtacggtacgtacgaccgaccgtatacgttacgttaccttacc

SEQ ID NO: 175118 - DNA, 597 bp, Homo sapiens
  misc_feature: GYAE6OF02FM7KJ.21.33.C11.1.454.CMB.1.raw
  modified_base (162)..(162): a, c, t, g, unknown or other
  misc_feature (162)..(162): n is a, c, g, or t
  modified_base (250)..(250): a, c, t, g, unknown or other
  misc_feature (250)..(250): n is a, c, g, or t
tcagtcgtcgctcgcacgaccggtgctcgatttagagtgagctcgtttgggtttggggggagaagagctgctcagtcaggacccagagggaaccatggaaaccccagcgcagcttctcttcctcctgctactctggctcccagaaaccaccggagagattgngttgacgcagtctccaggcaccctgtctttgtctccaggggacagagccaccctctcctggccggggccagtcaaattcgttacccgngacttacttagcctggtaccagcagaaacctggccaggctccagacctctcatccaacaatatacttcacgacggccgcgggacactcccgagacaggttcagtcggcaggtgggtctaggggacagtacttcacgtctacaccatccgaagcaagacgtggacgcctgaagtagttttcgactaagtagttattacgtagtcaagtcaaatatctacctacccgacccccgactaccctacccgttacgaccgtaaacgggactaacgacgtcgaccgaagacgtaacgaaacgacgtacgtacggaccgtacgtaccgtacctagtaccgttacgtacgttaccg

SEQ ID NO: 175119 - DNA, 601 bp, Homo sapiens
  misc_feature: GYAE6OF02GVIBD.21.33.C11.1.454.CMB.1.raw
  modified_base (60)..(60): a, c, t, g, unknown or other
  misc_feature (60)..(60): n is a, c, g, or t
  modified_base (352)..(352): a, c, t, g, unknown or other
  misc_feature (352)..(352): n is a, c, g, or t
tcagtcgtcgctcgcacgaccggtgctcgatttagagtgagctcgttgggtttggggganaagagctgctcagtcaggacccagagggaaccatggaacccagcgcagcttctcttcctcctgctactctggctcccagaaaccaccgagagattgtgttgacgcagtctccaggcaccctgtctttgtctccgaggggacagagccctaccctctcctgaccggggccagtcaaattgtacccgcgacttacttagcctggtaccagcagaaacctggccaggctccagactctcataccacaataagtacttcacgacgggccgcggcactccagactaggtcagtcggnacggtgggtctgggacaggacttcactcctacgaaccattccgagtcacgacgtggaacgtccgtagtaagtacttttcggactaaataggttaatttacctagttaccagtacctaaatcgttcgcccttaccgacccccgtatacgtacccttaccgggaccgaaaccgggtacaaccggttacacgtcgaagtacgtaacgaaacggaccgttgacggtcctagacccactagtctagttacctcg

SEQ ID NO: 175120 - DNA, 814 bp, Homo sapiens
  misc_feature: GYAE6OF02GGN05.21.33.C11.1.454.CMB.1.raw
  modified_base (256)..(256): a, c, t, g, unknown or other
  misc_feature (256)..(256): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgccacccgtctccgtggccggggccagtactaaattcgttacccgngaactacttagccctggtaccagacaacgaaccgtggaccaggcctacccagacctcctcactaccaactaattactacttacctacgaacgggccgacgggtacaacgtccccgaagtaaccgtagggtttaccagggttacggaccgtagggttacggggttccggtacgggggaaacctaacgggtaccttacgtaaaccgtccgttaacaacccgtaactaccggaacgaaccgtaacggtaaccgttacggggaacgtcccgtaagggtaaacgtttacggtttaacgaccgttaaagttacggtttaaactttacgttaggtaacctacgggtaactaaaagtacgttaccggacctaccccgaacccccgtacgtacccttacccggtttacggaacccggttaaacgggacccgtaaacgaacccggttacggacgtaacggtaaacgtaaacggtaaaacccgtaaccggtttacggtaaccggtacccgttaacggtaaccctaaacccggttaagtttaccgttaccggtttacccgtttaacccgg

SEQ ID NO: 175121 - DNA, 760 bp, Homo sapiens
  misc_feature: GYAE6OF02HIQFH.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccacccttgtctttgtctccgaggggacagacgcccaccctctcctggccgggcagtacaaagttcgtacccgctacctacttacgcctggtaccagacaacgtaaaccgtggacccgaggccctcccgaagaccctcctacacttacccaactaacttacttacttaccgtaaccggacggggtcccggcgggacctaacgtccccgaaaggtacccgtaacgggtttcgaacgggttcggtacgtacgggttcggggtacgttacgggggaacctagggttacccttactaccgttccgtaaccctaaccgttaaccgtacgacggtcgaacgggtccgttagggaccgttccgtaagggtaacgtttacgttttaggaaccttaaggtttacgttattacgttagtaccgacgtactaaatcgtacgaccctaccccggtaccccgtaatacccgtacccgttaccggaaaccgtaacggtaccgaaccggtgtaaccgcgaaagtacggtaaacggaaaccgtacgtcggtaccgtcgtaccgtaccgtaccctagttccgttaccgttccttaccg

SEQ ID NO: 175122 - DNA, 608 bp, Homo sapiens
  misc_feature: GYAE6OF02FYGDD.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagagccaccctctcctggccggggccagtacaaattcgtacccgcgacttacttagcctgtaccagcagaaacctggccaggcctccagacctctcatccacaatattattctacgacgggccgcgggcactcccagacgtaggttcaggtggcaggtgggcgtagggacagtacttcgactcctacacctatcagcagtaccgtggacgtcctaggaacgttagtttacgactaattgttaacttagtcgtacgacgtactaagttacgtcgtaccctacccgacccccgtataccctaccgttccggaaccgaacgggaaccacgaccgtacgaccaggtaacgtaacgaaaccgtacgtacggtcgtactacgtaccgactacgtcgttcgtacttacc

SEQ ID NO: 175123 - DNA, 625 bp, Homo sapiens
  misc_feature: GYAE6OF02ILT2F.21.33.C11.1.454.CMB.1.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtgagctcgttgggtttggggggagaagagctgctcagtcaggacccagagggaaccatggaaacccagcgcagcttctcttcctcctgctctctggctccaagaaaccaccggagagattgtgttgacgcagtctccaggcacctgtctttgctcgagggacagagccacctctccnggcgggccagtcaaattcgttacccgcactacttagcctgtaccagcaagaaacctggcctaggctcccacgactcctcaatccaanaactagtaacttcaacgaggccgacggacactcccgagaccgtaggttcagtggactaggtcgggtacgtgggaacacgtacttcaactctacgacctatcagcgagtacgtggactcgtagaacgttagtttcgactaagttacgttacttaacgtcgttacacgtactaaatcgtcgaccgttacccgaacccctacgtaccttaccgttaccggacgaaccggtaactaccggaactcgtcgaacgtagtaaccggaaacgttacgtaggttaccgacgttacggaaccgttaccgtacgttaccgttcgtaccttaaccg

SEQ ID NO: 175124 - DNA, 766 bp, Homo sapiens
  misc_feature: GYAE6OF02J1ROR.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccaagaaaccaccggagagattgtgttgacgcagtctccgaggcaccctgtctttgtctccgaggggacagacgcccaccctcgtccgtggccggggccagtactaaatttcgtacccgacgactacttagccgtggtaccagcaacgaacctggccgacggctacccgacgtacctcctacactccaacgtaactagttaacttccgtaccgaacggggtcccggaccgggtactacctacccgagtaaccgtagggtttaccagggttacggacgtacgggttgggtaccggttaggggaacctacgggtaacctttaccgtaaccgttccgttaccaaacccgtataccgaacggtaccgtaaggtaccgtcgggtaccgtaccggttaagtaaacgttacgtttcgaaacgttaagttacgttaacgttcgttacgttacgaacgtaccgttaaattacgtcgtacccgttaccccgaacccccgttacgttaaccccgtacccggttacccggacggtaaacgggtacccaaaccgtcctagacccgtaggtaaccgacggtaaacgtacgtaggttcgtaccgacgtaccacccgttactccggtttacttaccttaacccg

SEQ ID NO: 175125 - DNA, 693 bp, Homo sapiens
  misc_feature: GYAE6OF02H911R.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggccacctgtctttgtcctcgaggggacagtacgccaccctctcctggccggggccagtactaaattccgtacccgcgtacttactacgccgtggtaccagcaacgaaacccgtggaccaggcctaccgaacgtcctccctcactacccaataactattaccttacgtaacggacgggccgacgggacacgtacccgagtacgtacggttcaggtcggacgaggtcgggtacgtgggaacctaggtaaccttcaccttcgtaccaacccgtactaccgacgacgacgtacgtacggacgtccgtaggtaagttagtttacgactaagtttacgtaactttacgtagtacagtacctaattacgtacgtacccgtaccctaaccccgtactaccgtacccgtaccggaaccgtaaacggtaccaacgtacgtacgaccgtaaggtacgtaaacggtaacgtaacgttcggtacggtacgtaccgacctaacgtaccttacggtcgttaccttaccg

SEQ ID NO: 175126 - DNA, 884 bp, Homo sapiens
  misc_feature: GYAE6OF02ITI8H.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctcgagggacagacgccaccctctccgtgcgggccagtacaaattcgttaccccgcgactacgttacgtccgtacggtaccagcagaaacctcggaccaggcctaccagacctcctacacttcccaactaacttacttactttaccgaccgtaacgggggccccgacggggtaccctaactaccccgaacggtaaccgtaacggtttaccgaaacggtttgggacccgtaagggttaccggggttacggtacggggtaaccgtaaacgggttacccgtttaccgtaaccttacccgttaccgaaccccttaacgtccaaacggacccgtaaacggtaccggttaccggggtaacgtaccccgttaaggtaaacggttttacgtttttaaccggaccttaaaggtttaacggtttaacttttaaccggttacgtttaaccgtaacggttaaccttaaaagttaaccggttaccgtaccccgttaacccccggttaaacccccccgttaaaccgttaccccgtttaaccccggttttacccggggaaccccgggttaaacggggtaacccgaaacccggttaaccgtaccgtaccggaaaccgttaacggtaaacccgggtaaaacggtaaccgttaagggtccgggtcctaacggaacccgttaccgtacttccggttcgttaccttaccg

SEQ ID NO: 175127 - DNA, 645 bp, Homo sapiens
  misc_feature: GYAE6OF02G8LPC.21.33.C11.1.454.CMB.1.raw
  modified_base (251)..(251): a, c, t, g, unknown or other
  misc_feature (251)..(251): n is a, c, g, or t
  modified_base (444)..(444): a, c, t, g, unknown or other
  misc_feature (444)..(444): n is a, c, g, or t
  modified_base (593)..(593): a, c, t, g, unknown or other
  misc_feature (593)..(593): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctcaggcaccctgtctttgtctccgaggggacagacgcccaccctctcctggccgggccagtacaaatttcgtacccgngactcttacgccgtaggtaccagacaacgtaaccgtggaccacggcctaccgagacctcctcactcccaactaatacttacttaccgaacgacgggcccggcggaccacgtcccgaagtacgtaggtttacaggtggacgtaggttgggtccgtagggaccgacgtaccgttcaccgttcctaccgtaacctntaccgacgaccgtacgaacggtacggacgtaccgtaagtaaagttacgtttagacttaaagtttcgttaaactttaggttcgtacgaagtacttaagtactcgtccctacccgaacccctgtacccaccgtccggaacaacggacacgnacgcgatacgaacgtaactacgtgacgngacncacctcgtcttgttacctcg

SEQ ID NO: 175128 - DNA, 684 bp, Homo sapiens
  misc_feature: GYAE6OF02FUW72.21.33.C11.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcacctgtctttgtctccgaggggacagagccaccctctcctggccgggccagtcaaattcgtacccgcgactacttagcctgtaccagcagaaacctggccaggcctcccagacctcctnactaccaactaatatacttctaccgacggggtcccgcgggcctacgtccccgaagaccgtaggttacgagtgggctaggtgggtctagggacacggtacttcacctctaccaccatccgacgtcaggaccgtagggacgtcctaggtaaagttacgttttgacgttaagttacgtaactttacgtacgttacgtacgtactaagttacgtcgtacccgtaccccgtaccccgtacgttacccgtacccgttaccgggtacccgtaaaccggggaaccctaaccggaccgttacgaccgtaacgtaacgttaacggaaaccggttaaccgtacggttacggtacgtaccgaccgtaacccgtattaccgttacgttccttaacccg

SEQ ID NO: 175129 - DNA, 646 bp, Homo sapiens
  misc_feature: GYAE6OF02F324L.21.33.C11.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacagagcccaccctctcctgccggggccagtcaaattcgtacccgngactacttagcctggtaccagcagaaacctggccaggcctcccagacctcctacactccaactaatactacttcctacgaggggcccgcgggccacgtacccgaagaccgtaggttacaggtcggaccaggttcggggtactggggaccaggtacttacgaccttctaccaccctagtccgagacgaagtacgtaggacggtcctaggaagttatttacgataagttagtacttactggtacagtacaatacgtacgtacgtacccaacccccgtatcccgtaccgtaccgtaccgtaaacgggacccaacgacctacgacgtaagacgttaacggaaaccgtacgttacggtacggcttacgaccgtaaccgtacgttaccgtccgttaccttaccg

SEQ ID NO: 175130 - DNA, 762 bp, Homo sapiens
  misc_feature: GYAE6OF02G7EJA.21.33.C11.1.454.CMB.1.raw
tcagtcgtcgctcgcacgaccggtgctcgatttagagtgagctcgttagggtttgggggagaagagctgctcagtcaggacccagaggaaccatggaaacccagcgcagcttctcttcctcctgctactctggctcccagaaaccaccggagagattgtgttgacgcagtctcaggcaccctgtctttgtctccaggggacagagccacctctcctgcggggccagtcaaattcgttacccgcgactacttagcctggtaccagcagaacctggccaggtcctcccgagtacctccgtacactacccaacgtaaatacgttacttccttaaccggacggggcccgcgggactaacgtccccaaggaaccgtacgggtttacaacggttgggacctaagggtttcgggggttaccttagggggaaccgaacgggttaaccttcgaaaccgttccgtaccgtaaaccctaagtacccggtaacggtcgaaacggtaccgtacgggaacggtcccgtaaggtaaacgttacgttttacggacttaaagttgttaacgttacgttggttacgacggtactaacgttatacgtacctacccgtaacccccgtagtacccgtaccggttaccggaacccgtaaacgggtaacctacggtaccgtacggtaccgtaacggaccgttaacggaaacccgtaacggttacggtacgggtaccgtacgtacccgtaccgtaaccgtttccggttacgttaccctttaacccg

SEQ ID NO: 175131 - DNA, 625 bp, Homo sapiens
  misc_feature: GYAE6OF02IU6F3.21.33.C11.1.454.CMB.1.raw
  modified_base (298)..(298): a, c, t, g, unknown or other
  misc_feature (298)..(298): n is a, c, g, or t
  modified_base (424)..(424): a, c, t, g, unknown or other
  misc_feature (424)..(424): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattcgttacccgcgactacttagcctggaccagcagaaacctggccaggcctccagacctccncatccaactaatatacgttctacgacgggccgcgggcatcccagacctagggttccaggttcggactaggttcgggtacgtgggaacacgtacttcgactcgtcaccatccagcagtactgggacnccgtagaacgttatttacgactaattacggtacttacgttcgtacacgtactaacgttagtcgtaccgtaccctaacccccgtattacccgtaccgttaccggacccgtaaacgggacctaacggtacctacggactaggacgtaacggaaaccgtacgtcggtacgtacgtacgactaccgtatccgttcgtcttacccg

SEQ ID NO: 175132 - DNA, 661 bp, Homo sapiens
  misc_feature: GYAE6OF02JAL25.21.33.C11.1.454.CMB.1.raw
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtgagctcgttgggtttgggggagaagagctgctcagtcaggacccaggagggaaccatggaaaccccagcgcagcttctcttcctcctgctactctggctcccagaaaccaccggagagattgtgttgacgcagtctccaggcaccctgtctttgtctccaggggacagagcccaccctctccgtgcgggccagtctaaattcgtacccgcgtactacttagcctggtaccagcagaaacctggccaggcctccagactcctanactccaanaatatacttcacgacgggtccgcggcactcccagacgtaggttcaggtggacaggttcgggtccgtagggacacggtaaccttcaacgttctaccgaccctaacgtccaacggctaagacgtaggacgtaccgtaaggtaacgttatttagactaagttacgtattacgtagtactaagtactaagttactcgtaccgtaccccgtaaccccgtatacccgtaccgttcccggaaccgtaaccgggaaccctacggtacctacggtacgaacgtaacgtaaccggaaaccggtacgtacggtaccggtacgtacgtacctaaccgttacgtacgttccggtacctttacccg

SEQ ID NO: 175133 - DNA, 925 bp, Homo sapiens
  misc_feature: GYAE6OF02HTIM6.21.33.C11.1.454.CMB.1.raw
  modified_base (270)..(270): a, c, t, g, unknown or other
  misc_feature (270)..(270): n is a, c, g, or t
tcagtcgtcgctcgcacgaccggtgctcgatttagagtgagctcgttgggtttggggggagaagagctgctcagtcaggacccagagggaaccataggaaaccccagcgcagcttctcttcctcctgctactctggctcccagaaaccaccggagagattgtgttgacgcagtctcgaggccaccctgttctttgtctccgagggacagacgccaccctctccgtggccgggcacgtactaaacgttcgtacccgacgtactacgttacnccgttaggtaaccagacaacggtaaaccgtcggccaggccctacccgagtaccctccttacactcccaactaattacttacttacgtaacggacgggtcccggacgggacctaacctaccccgaaggtaaccgtagggttaccgaagggtccggacgtacgggttcgggggttaccgtaggggtaacctaacgtaccgttttaccgaacgttaccgtaccgtaaacccgtattacccgaaacgggtaccctaaacgggtacggttacgggtaaacccggtacccgttttaaacggggtaaaacgttttaggttttaaccggtaaacgttaaacggttttacggttttaaaccgtttaacggtttacgtaaccgttaaaccggtaactaaacgttttaacgaccgttaccccgttaacccccgtaaccccccggttaacttaccccggttaaccgtttaaccccggggaaacccggtaaaacccggggtaccgtaacccgggttaaccggttaccgaaccggttaaacggtaaccggttaaaaccgggtaaaacccggttaacggttaaccgggtttacccggtccggtaacccggttaccccgtaacccgtttaaccggtttaaccccggtttacgttttaccccgtttaacccg

SEQ ID NO: 175134 - DNA, 695 bp, Homo sapiens
  misc_feature: GYAE6OF02JQ1XQ.21.33.C11.1.454.CMB.1.raw
  modified_base (262)..(262): a, c, t, g, unknown or other
  misc_feature (262)..(262): n is a, c, g, or t
tcagtcgtcgctcgcacgaccggtgctcgatttagagtgagctcgttgggtttgggggggtaggaagaggctgctcagtcaggacccagagggaaccatggaaacccagcgcagcttctcttcctcctgctactctggctccagaaaccaccggagagattgtagttgacgcagtctccaggcaccgtgtcttgtcctccgaggggacagacgtcccacccgtctccgtcgccggggaccaggtaccaaattcggtacccgngtacctacgttagccgtcggtaccagaccaacgaacctggccagggcctacccgagtaccctccgtccactccaacctaattactaacgttcctaacgacggggtccgccggggactaccgtacccgaacggtaacctacggttacggacggcgggtaccaagggttgggtccgttacggggacctaggtaccttacaccgttcctaccgaaccctaggtaccacgtacgaccgtacgtcgggtaccggacgtaaggtaacggttagtttagaccgtaagttacgttaacgttacgttaacgtaccgtaataccgtaacttagtccgtacctaccccgtacccctacgtaccgtacccgtcgaaccgtacgggacacgctcgacagacgtaacgtactatcggtcagtcacgtcctagtcccttagttccgtc

SEQ ID NO: 175135 - DNA, 610 bp, Homo sapiens
  misc_feature: GYAE6OF02F3GXG.21.33.C11.1.454.CMB.1.raw
  modified_base (411)..(411): a, c, t, g, unknown or other
  misc_feature (411)..(411): n is a, c, g, or t
  modified_base (445)..(445): a, c, t, g, unknown or other
  misc_feature (445)..(445): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctggccggggccagtcaaattcgttacccgcgactacttagcctggtaccagcagaaacctggccaggctcccagacctcctcactccaacaatatattctacgacgggccgcgggccactcccagacaggttcaggtggcaggtgggtctgggacagtacttcactctcaccatcgacgcagacgtggacncgtagaagttatttgactaatagtactttacgtntacagactaatatcgacctacccaacccccgtactaccgtaaccgttaccggaacccgtaacgggaccctaaccgtacttacgacgaaggacgtaacggaaaccgtaacgtacggtacgtccgtacgtaccctaaccgtacgttaccgttacgttccttaacccg

SEQ ID NO: 175136 - DNA, 747 bp, Homo sapiens
  misc_feature: GYAE6OF02HYS5C.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccaagaaacccaccggagagattgtgttgacgcagtcctccgaggcctacctgttctttcgtctccgaggggtacagacgccaccctctccgtggccgggccagtactaaagtttcgtacccgcgtaacctacttacgccttaggtaacccagacctaaacggtaaacccgtggacccgaacggtccctaccccgtaagtacccttccgtacactacccaactaaattacttaactttccgaacggacggggtcccggccgggtacctaacccgtacccgaaggtaccgtacggttaccgaggtcggacgtaggtcggtacgtagggactacgtaccttacactctaccacagtaccagtccaacggtcgtacggactaccgtagtaacgttacgtttacgaacttaagttacgttaacttacgtagtactaacgtaactaagttcgtacccgtacctaacccgtaccccgtactacccgttaaccgttacccggaacgttaaaccgggaccaaccggtactcggaactacggtaacgtaaacgaccggtacgttcgggtacgaccgttacgacccgtaaccttaccgttaccgttcgttacctaaccg

SEQ ID NO: 175137 - DNA, 705 bp, Homo sapiens
  misc_feature: GYAE6OF02HY688.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaagaaaccaccggagagattgtgttgacgcagtctccaggcaccctgtcttgctccgagggacagacgccaccctctccgtggcgggccagtacaaattcgttacccgcgactacttagcctggtaccagcaagaacctggccaggcctcccagaccctccgtcactacccaataatacgttattaccaacgacgggcccgtacggccacgtcccaagacctaggttcaggtcggactaggtcgggtactggggaactacggtaccttacgaccttaccgtaccaaccctagtaccgaaggtaccgaacgtaacggttacgggtaaccgtcccgttaaagggtaaacgttacgttttacgaaaccgttaaagtttacgtttaactttacgttacggtacaacggtaacctaaagttcgtaccaccgttacccccgtacccccgtactacccgtacccgttaccggaaccgtaaacggaaccaccgtacgacgacgaagtaacgaacgtaaacgtacgtaggtacggtacctcgaccgtacctacgttcgttacgtccttaaccg

SEQ ID NO: 175138 - DNA, 732 bp, Homo sapiens
  misc_feature: GYAE6OF02ICQ7G.21.33.C11.1.454.CMB.1.raw
tcagtcgtcgctcgcacgaccggtgctcgatttagagtgagctcgttgggtttggggggagaagagctgctcagtcaggacccagagggaaccataggaaaccccagcgcagcttctcttcctcctgctactctggctcccaagaaaccaccggagagattgtgttgacgcagtctccaggccaccctgtctttgtctccgaggggtacagacgccacccctctcctggcgggccagtacaagtttcgtacccgcgaactacgttagccgttcgaccagcaagaaaccctggacccaagggccctacccgaacgtacctccctactaactacccaataaattaacttatttacctaacggacgggtacccggaccgggcacgtacccgagtaaccgtacggtcgacggtcggcgaaggtggggtacacgggacaggtactttcgacttccacctaaccatccgtacgaccgtaacgtaccgtaggtaccgtccgttaaggtaacgtttagttttacggaaccgttaaagtttcggttaatttaacgttcggttaacagtactaaattcgtacctaccgtaacccccgtaaccccgtactaccccgttaacccggttacccgggaaccgtaaaccgggtaccgtaaccgaccgttacgacgttaaccgacgtaacgggaaacttacggtggttaccgcgtaccgactacccgtattacgtccttacttacccg

SEQ ID NO: 175139 - DNA, 792 bp, Homo sapiens
  misc_feature: GYAE6OF02G2DZY.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactcctggctcccagaaaccaccggagagacttgtgttgacgcacgtctccaggccacctgtctttgtctccgagggacagacgccaccctctcctggcgggccagtacaaattcgtaacccgcgtacctacttagcccgtagtaccagacaacgaaaccgtcggccgacggcctcccgacgtacctcctacactccaactaatacttacttacctacgacggggccgcgggtacactcccgaagacgtacggttaccgaaggtggaccgtacgggttcggggtacgtagggggaaccgtaaggtaccggtttacctaaccgttccttacccgaaccctagtacgaccgtacgaacggtaccggtacggtaacgtacccgtaggtaaagtttacttttacggaacttaaacggttacggtttaacctttacggttaacgttacccgtaaaggtaacctaaacgtttagtcccgtacccttaacccccgaccccggttacttacccgttaaccccgttaccgggaaccccgtaaaggggtaccctaaaccggtaccgtacggtaccgaacgtaaccggtaaaccggtaaaccgttaaccggtcgggttaccggtacgtaacccgtaacccgtaaccgttacgtccgttaccgtttacttaccccg

SEQ ID NO: 175140 - DNA, 587 bp, Homo sapiens
  misc_feature: GYAE6OF02GQR5C.21.33.C11.1.454.CMB.1.raw
  modified_base (448)..(448): a, c, t, g, unknown or other
  misc_feature (448)..(448): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaaccaccggagagattgtgttgacgcagtctcaggcacctgtctttgtctccaggggacagagccacctctcctgcgggccagtcaaattcgtaccgcgactacgttagcctggtaccagcacgaaacctggccaggcctccagactcctcactccacaatatacttctacgacgggccgcgggcactccccagacgtaggttacaggtggccaggtgggtctgggacagtctacactctaccacaagtccagcagactggacacgtacgaagttactttaggactaagttgttacttagttacgntacgactaatactacgcctacccgaccccgtactaccctaccgttccggtaccgtaacggaccacgacttggacagaacgtaacgaaacgtacgtaggtacgacttggacctaccgtacttcgttaccgttacgttacc

SEQ ID NO: 175141 - DNA, 773 bp, Homo sapiens
  misc_feature: GYAE6OF02IT645.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccagaaaccaccggagagattgtgttgacgcagtctccaggccacctgtctttgtctccgaggggacagacgcccaccctctcctggccgggccagtacctaaatttcggttaccccgcgtaccttacgttacgccgtggtaacccaggaccaacggaaacccgtcggaccgtaacggcctacccgaacgtaccctccctcctaactaccccaaactaaacttaacttaactttacccgtaaccggacgggggccccggaccggggtacctaaccgttacccccgaaggtaaccgttacgggttacgtaacgggtacgggacgtacgggttcggggttacgtacgggggaactaccggtaaccctttccgaaccgtttcccgtaacccgtaacccgtaactaccgaacggtacaacggtaccgtagggtaaccgtaccgtaggtaacgttagttttacgaacgttaagttacgtttaacttaacgttcggttaacaacgtaactaaagtcgtaccgtccctaccccgtaccccgtactacccgtacccgtaccgaaccgaacggactaccgactcgacgagtacgtaacgaaccgtagtcgtacggctacgactaccgtacgtcttcgtctacc

SEQ ID NO: 175142 - DNA, 743 bp, Homo sapiens
  misc_feature: GYAE6OF02H2ZUZ.21.33.C11.1.454.CMB.1.raw
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
  modified_base (425)..(425): a, c, t, g, unknown or other
  misc_feature (425)..(425): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccacctgtctttgctccgaggggaccagacgccaccctctccgtgcgggccagtcaaaattcggttacccngtacttactacgcctaggtaccagcaacgtaaaccgtggaccaggcctcccagtactccnctaactcccaaanaaactttagttaacttcctaacggacggggacccgtccgggactaaccgtcccaaggtacctaaggttcaagggtcgacgtaggtcgggtctagggaacctntaacgtttccaacgttctacctaaacgtacttacggacgtacaacgtcgtacggtaacgccgtaagtaaacgttagttttacgaccttaaagttcgtttaaacgtttacgtacggttacgaacgttaacgtaaataccgtacgggtacccttaacccgaaccccccgttagttaccccgttaacccgttcccgggtaaccgaaaccgggtaaacctaaccggtaccttaaccggacgttaaacggaggttaaaaccaaccggtacgttacgtacggacttacggacctaaccttacgttaccttcggttacttacccg

SEQ ID NO: 175143 - DNA, 865 bp, Homo sapiens
  misc_feature: GYAE6OF02GP1DI.21.33.C11.1.454.CMB.1.raw
  modified_base (265)..(265): a, c, t, g, unknown or other
  misc_feature (265)..(265): n is a, c, g, or t
  modified_base (307)..(307): a, c, t, g, unknown or other
  misc_feature (307)..(307): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccagggacagagccacctctcctgcgggccagtcaaagttcgtacccgcgactacttacgcctggtaccngcagaacctggccaggcctccgagacctcctacactaccaanaactctattacctacgacggggtcccgacgggcctaacgtccccgaagacgtacgggtttccaaggttcggacgtaggttcggggttacgtagggggaacctaacgggttacccttacgtaccgttacccgtaacccgtaaaccctaaggttccctaacgggaacccgtaacgggtaaccggtaccgggggtaccgtaacccggtttaacggtaaacgggtttaacggttttttacgaacgttaaacgggttttacggttttaaaccgttaccggtttaacgttaacccgttaacggttaaccgttaaaagtttaccggttaccggtaccccgttaacccccggtaaaccccccgttacgttaacccccgttaacccggttaccccgggtaaaccgggtaaaccgggtaacccgtaaccgggtacccgtaaccggtacctaaacgggtaaccgtaaaccgggtaaaacgtttaaccggttaacgggtacggtaaccccgttaccgggacccgttaaacccgtaccgtttaaccggttccgttttaacccgttaacccg

SEQ ID NO: 175144 - DNA, 879 bp, Homo sapiens
  misc_feature: GYAE6OF02J1LBG.21.33.C11.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtcnccaggcaccctgtctttgtctccgaggggaccagacgccacccgttctcctaggccgggacctacgtactaaactttcgttacccgacggacttacttacgccgttcggtaaccacgacaagtaaacctgggtccaggcctaccccagtaccctcctacgacttcccaacgtaacttactaacgtttacctaaccggacggggtcccggaccggggtctaacccgttccccgaaagtaaccggttacggtttaccggaacggttacgggccttaacgggttccggggtttaccgtacgggggaaccttaacgggtacctttttacccgaacgttccgttaacccgtaacccgagttaccgaacgtaccgaacgtacgtcgggaccgtccgtagtaacgtacgttttagaacgttaacgttacggttaattaaccgttcggttaccgtaacgtacccgttaaagttaccgtacgttacccgttaaccccgtaacccccggttacgttaccccgttaacccggttacccgggtaaacccgggtaacccgggttaaaccgaacccggttacggtacccggttaccgtaaccggttaacggtaaaccggttaaaccgaaccgggtttaccgggttacggtaaccgttacccggtaccgttaaaccccggttacgtttaacccggtttaccggttacccttttaacccgg

SEQ ID NO: 175145 - DNA, 743 bp, Homo sapiens
  misc_feature: GYAE6OF02II04U.21.33.C11.1.454.CMB.1.raw
  modified_base (716)..(716): a, c, t, g, unknown or other
  misc_feature (716)..(716): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccaagaaacccaccggagagattgtgttgacgcagtctccaggcaccctgtctttgctcgaggggacagacgcctaccctctcctggcgggcctagtactaatttcgtaccgcacttactgcctggtaccagcaagaacctggccaggtcctcccgagtacctcctcactcccacaaacttacgtactttaccgaccgacgggccggaccggacctaacgtccccgaagtaaccgtacgggttacacgggtcgtaccgtaggtccgggtacgtacgggacctaggtaccctttacaccgttaccacctaacccgagtaccgaacggtcgaacgtacgtaacgggtacggtacccttaaggtaacgtttacgttttacgaacttaacgttacggttttaacgttaacccgttgggttaaccaaggttacctaaattacgtaccggttaccctaaccccgtaaacccccgtgttacccgttaacccggttacccgggaacgtaaacccggggtctaaacccgaagttccgacgtaacgtaccgtaaacgtaaaccgtccgtaggtaccgtcacggaaccncgtaacggtcttaccgtccgttaaccg

SEQ ID NO: 175146 - DNA, 761 bp, Homo sapiens
  misc_feature: GYAE6OF02HI839.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaaccaccggagagattgtgttgacgcagtctccaggcaccctgtctttgtctcaggggacagagccacctctcctgcgggccagtcaaattcgttaccgcgactacttagcctggtaccagcaagaaacctggaccaggcctcccagacctcctacactcccaacaaatattattctaacgacggggcccgacgggcaactccccgaagtaccgaggttccaaggttcggctaggtgggtacgtcggggaactaggtaaccgtttcaacgttcctaccgtaaccctattccaaacgccgaacggtaaccgttcggggaacgacccgttaggtaaacggttaagttttccgtactaaagttacggtttaaactttacgttacgttacgtaaacggtaccttaaaacgttactccggtaccttaccccgtaaccccccggtaactttacccgtaaacccccggttttaccggggaacccggtaaaaccgggtaacccaaaccgggtaccgtaccgggtacaacggtaaccggtaacggttaaaaacccgtaacggtacggttacggtaccgtacggtacccgtaacccgttaacgttccggttacgttaccctttaaccgg

SEQ ID NO: 175147 - DNA, 596 bp, Homo sapiens
  misc_feature: GYAE6OF02JDPA3.21.33.C11.1.454.CMB.1.raw
  modified_base (246)..(246): a, c, t, g, unknown or other
  misc_feature (246)..(246): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgtacccgngactacttagcctggtaccagcagaaacctggccaggcctcccagactcctcatccaacaataatacttctacagggccgcggcatcccagacaggttcagtggcaggtgggtctgggacaggcttcactcncaacatacagcagacgtggacnccgtagaagtattttgacgtaaattcgttaaatttctagttacaacgactaaattacgttcgaccttaccccaaccccccgtactaccctaaccgttccggaaccgtaacgggaaccaaccggactcggacaggaataacggaaacgtaacgtagtaccggtactcgacgtaacctattaccgttacgtcttaccg

SEQ ID NO: 175148 - DNA, 762 bp, Homo sapiens
  misc_feature: GYAE6OF02J0UTR.21.33.C11.1.454.CMB.1.raw
tcagtcgtcgctcgcacgaccggtgctcgatttagagtgagctcgttggggtttggggggagaagagctgctcagtcaggacccagagggaaccatggaaaccccagcgcagcttctcttcctcctgctactctggctcccacgaaaccaccggagagattgtgttgacgcagtctccgaggcacccgtgttctttgtctccgaggggacagacgcccacctctccgtcggcgggaccagtacaaagttcggtaccgcgtactacttagcctagaccagacaacgaaccgtcggaccgtacgcctacccacgtccttcctacgactccaactaactactacttaccgtacgacgggtccggccggaccacgtacccgagaacgtacgggttacgacggtcggtacgtacggttcgggtacggtacgggtaacgacggttaccgtttacgaccttacctaccaaccgttaacgtaccgaaccggtacgtaacggaccggttagggtaaccgtaccgtttaagggtaacgtttaacgtttacgaaacgttaaactttacgggttaacttacggttacgacttaacgaaccttagttacctccgttaacccgtaccccgtaaccccgtaccttacccggttaccgtaccgggtaacccgtaacggaacctaccggtacgtacgtacgaacgtacgtaaccggaaattcggtccgtaagccgttaccgaaccgttaaccctacgttacggtttacccttagtcccg

SEQ ID NO: 175149 - DNA, 906 bp, Homo sapiens
  misc_feature: GYAE6OF02IH355.21.33.C11.1.454.CMB.1.raw
tcagtcgtcgctcgcacgaccggtgctcgatttagagtgagctcgttgggtttggggggagaagagctgctcagtcaggaccagagggaaccatggaaaccccagcgcagcttctcttcctctgctactctggcctccaagaaaccaccggagagattgtgttgacgcagtctccgaggcctaccctgttctttgtctaccgaggggacacgacgcccaccctctccgtcggccggggacctagtactaaagtttccgtacccgcgtaaccttacttacgccgtaggtaccagaccaacgtaaaccgtcggaccacggcctaccccacgtaccttccgtactaccgtacccaaagtaactttaccgttacctttacgtaaccggaaccgggggtcccgggaccggggtacctaaccgttacccccgtaaaggtaaccggttaaccgggttaccgagggtaccggtaccggtaggttcgggggttaccgtaacgggacctacggtacccgtttaccgaaccgtttccgtaacccaaccttacgttaaccggaacggaccgtaacggtaacggtccggggtaaccgttaccgggttaaaggttaaacgttttgtttttaaacgggaaccttaaaacgggttttacgttttaaacgtttaacggtttaccggtttaaccaacggttaaaccttaaacgttaacgttccgtaaccccgttacccccgtaaacccccgttactttaaccccgtaacccggtttaccggggaacccgtaaaacgggtaacccgtaaccggtaacgttacggacccgttaaggaaaccggttaaacggaaaccgttacgttcgggttaccggacgtaccgtaccttaaaccgttcgtttaccgttaccgtttcctttaacccg

SEQ ID NO: 175150 - DNA, 652 bp, Homo sapiens
  misc_feature: GYAE6OF02F1XNS.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcgggccagtcaaattcgtaccgcgtactacttagcctaggtaccagcaagaaacctggccaggcctccagtacctcctcactccaacaatactattcctaacgacggggtccgcgggcactcccgaagaccgtagggttcaggtggactacggtgggtcgtgggaacaggtccttacaccttcgtaccacctatcgagtacacgtacgtaggacgtcgtagtaacgttagtttcgacgtaacttgtaaatttacgtcgttacaacgtactaaagttacgtcgtaccctacccgaacccccgtacttaccccgtaccggttacccggtaaccgaaacggacctaaccgtacgcgtacgaacgtaacgtaacggaaccgtaaggtcggtacgacgttccgaccaaccgtacgttacgttacgttccttaacc

SEQ ID NO: 175151 - DNA, 630 bp, Homo sapiens
  misc_feature: GYAE6OF02G5LLF.21.33.C11.1.454.CMB.1.raw
  modified_base (599)..(599): a, c, t, g, unknown or other
  misc_feature (599)..(599): n is a, c, g, or t
  modified_base (603)..(603): a, c, t, g, unknown or other
  misc_feature (603)..(603): n is a, c, g, or t
  modified_base (625)..(625): a, c, t, g, unknown or other
  misc_feature (625)..(625): n is a, c, g, or t
tcagtcgtcgctcgcacgaccggtgctcgatttagagtgagctcgttgggtttggggggaggaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagcccacctctcctggcgggccaatcaaattcgtacccgcgactacttagcctcggtaccagcagtaaactggaccaggtctcccagtactccctcgactaccaacaatacttacttcctaacgcgggccgcggacactcccagactaggttcagtggctaggtgggtctagggacaaggtctcaccgttcactacatctaacggctaacgtacgtcggacgtacccgtaggaaacgttcttttagaaccgttaaacttacggtattaggtaacctaaacgtagttaactacgtacgttactttacccgtttacgtaccgtttccggacccgttggaacccggttataccggtaatacctaacgtaactacgtgttacgctacgactaacgnttcncgtttctctacgttcctcccgntaccg

SEQ ID NO: 175152 - DNA, 716 bp, Homo sapiens
  misc_feature: GYAE6OF02GQTBT.21.33.C11.1.454.CMB.1.raw
  modified_base (179)..(179): a, c, t, g, unknown or other
  misc_feature (179)..(179): n is a, c, g, or t
  modified_base (348)..(348): a, c, t, g, unknown or other
  misc_feature (348)..(348): n is a, c, g, or t
  modified_base (505)..(505): a, c, t, g, unknown or other
  misc_feature (505)..(505): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccagaaaccaccggagagattgtgttgacgtcagtctcgnggccaccctgtctttgtctcgacgggacagacgccgacctcctcccgtggccggggcccagtaccaaagtttccgtacccgcgaccgttacttacgccgttacggaccctaagccgtaacggaaaacccttcggggacccaaggccttacccgacgtaccctacccctnaacctcccaagtaaactactaacttactaaccggcggggccggcggacctacgtcccaaggtacgtacggtttcgacgtcggactaggtgggtcgtaggaccagtacctacaccgtcaccgacactcacgacacgtacgtggacgcgtagaacgttntttcaacgttattacggtacttcgtacgtacgtacgtanaaacttnttccggaccctcccgttaaaccccgtctaacccgttcccgttacccgtaccggtaacggtaacccaacggtacctacggcctaaaggaccgttaacgaaacccggttgtacggggtaccgttacgtacgaaccgtaccgttactacggtttcccttactaacccc

SEQ ID NO: 175153 - DNA, 860 bp, Homo sapiens
  misc_feature: GYAE6OF02HMSV5.21.33.C11.1.454.CMB.1.raw
  modified_base (152)..(152): a, c, t, g, unknown or other
  misc_feature (152)..(152): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctgctccagaaaccaccgganagattgtgttgacgcagtctccagccaccctgtctttgtctaccgagggacagacgaccacccgttctccgtggccgggccagtacaaagtttcgtacccgacgtaaccttacttacgtccgttacggaacccagtaccgaaacgaaaacccgttcgggacccacggaccgttacccccgaacgtaaccttccccttaccgaacttaccccaaaactaaaacttaaactttaaacgtttaacctaacgggtaacgggggtccccgggaccggggtaccctaaaccgttaccccgaaacggtaaactaaccgggggtttacctaaccggggtttagggaccgtaaacggggttcggggtttaaccggtaacggggggtaaaccctaaagggttacccctttacggtaaaccttccctaacgtaaaccctaacgtacgaaacgtaccgacggtaacgttcgggaactaccgttaaacggtaaacgtttaatttacgtaacgtaaactttagttaaacgtttaccgttagttacgaacggaaccttaaatagtttacggccctaaccgtaaaccccccgattaacccgtaccgttaccggaaacccgaaacggaaccgacgtaccttacgacgtaagaggtaaaccggaaactaacggcgttaacggtccgtaacgaccaacccgtattccgttacgttacgtttaacccg

SEQ ID NO: 175154 - DNA, 829 bp, Homo sapiens
  misc_feature: GYAE6OF02ICF4H.21.33.C11.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagagtgagctcgttgggtttgggggggagaagagctgctcagtcaggaccagagggaaccatggaaaccccagcgcagcttctcttcctcctgctactctggctccagaaaccaccggagagtattgtgttgacgcagtctcaggccacctgtcttgtctccgagggacagcgcctaccctctccgtcggcgggaccagtactaattccgtaccgctactacgttacgctcggtacagctaacggaaccgtcggaccacggtcctacccgagtaaccncccttacactcccaaacgtaattattacttaccaaccgggcgggcccggcgggtacctaccgacccgtaaggtaaccgttacggttaccgtaggtcgggaccgttaaggggttccgggttacggtacgggtaaacaccggttacttaccgtaaccgttcctaaaccgtaccccgtaacgttaccggaagttaccggaccgggttaacgttaccggggaacccttaccggttaaaggttaaaacgtttcgggtttaaccgacgtttaaacggtttcggttaacgtttaaaccgtcgtaaaccggtactaaaccgttaacgtttacgacccggttacccgtaacccccggttaaccccgtacgtttaaccccgttaacccggttttaccgggaaaccgtaccggggtaaaccgtaccgttacggtacgacgtaaacggtaccggtaaaacgtaaccggttaactcgggtcgtaccggtaccgtaacccgaccttacggtcgtttccgttacctaacccgg

SEQ ID NO: 175155 - DNA, 891 bp, Homo sapiens
  misc_feature: GYAE6OF02G2IEZ.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctcgagggacagacgccaccctcctcctcggccggggcctacgtactaaacgttcgttaccccgacgtacttaacgttacgtccgtaggtaccagaccaacggaaaaccgtcggacccgaacggtcctacccgagtacccttccctacctactacccaactaataacttaactttccgtaacgacggggcccggacggggacctacctacccgaacgaacgtacggttacacggttcgggacgtagggttcggggtaccgttggggaacctaacggttacctttaccgtaacccgtttaccaccctaacccaagtaccgtacgaccgtaacggtacgtacgggaccgtaccgtaagggtaacgtttagtttcggaaccttaaagtttacggtttaaactttccggttaacggtacgtaaacggtaccttaaacgttacgtttccgtaccccttaaccccccggtaacccccgttaccgtttaaccccggttaaacccccggtttacccgggaacccgggtaaaaccgggaccccgtaaaccgggtaccttaacggttacccgttaaacggtaaaccggttaaaccggtaaaacccgggttaaaccggtttaccggggttaccgggtaaccgttacccgggtaacccgttaaccccgttaacggtttacccggttttcggtttacccgtttaaccccg

SEQ ID NO: 175156 - DNA, 802 bp, Homo sapiens
  misc_feature: GYAE6OF02G9WE3.21.33.C11.1.454.CMB.1.raw
  modified_base (365)..(365): a, c, t, g, unknown or other
  misc_feature (365)..(365): n is a, c, g, or t
tcagtcgtcgctcgcacgaccggtgctcgatttagagtgagctcgttgggtttggggggaggaagagctgctcagtcaggacccagagggaaccatggaaaccccagcgcagcttctcttcctcctgctactctggcctcccagaaaccaccggagagattggtgttggacgcgagtctccaggccaccctgttctttgtcgtaccgagggcagacgccacccgtctcctgggccgggacctacggtacaaacggtttcgttaccccggagtaccttacttacgcctagggtacccagacaacgaaaccgtggccaggcctccactacgtccactacgaaccaacgtaattaatacttcgtaacncgggtccgaccggacacgttcccgaacgtaacggtacggttacgaggttacgggtcaacggggtttggaccgtttaggggacccttaaaaggtacccgtttccctaacggtaccgtaccccgaaaccctggtttaacccgagggaaccctagggtaacgttacgggtactaccggtaacggtaacgttaaggtttttacgaacgttaacttacggttaatttacgtagttccgaaacgtataaacgtagttaccgtaacccgtacccggtaacccccctaacgtacctttaacccgggttaccgtaccgaaaccggggtaccgtaacccgtaccgtacgtaccgtaaggtaacggtaacgtaaaaccgaaccgttacgggttaccgaaccgttccggaaacctacccgtaagtttccgttacgttaccgttaacccg

SEQ ID NO: 175157 - DNA, 878 bp, Homo sapiens
  misc_feature: GYAE6OF02HTACC.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctcggcctcccaagaaacccaccggagagtattgtgttggacgcaggttctccaggcctaccctgttcgtttcgtcctaccggaggggaactacggacgccctacccttcctcccgtggccgggtaccaagtacctaaatttccggttacccgacgtaccttacgttacgtcccgtacggttaaccgagccgtaacggtaaaccgtcggacccgtacgggtaccctcccgtacggtacccttacccgtacctaacgttacccctaaacctaacttacgttaacttttccctaacggtacgggggcccggtaccgggtacctaaccgttcccccgaaacgggtacctaacggggtttacacgggttacgggcccttaaaggggtccgggttaccgttacggggaccgtaacggttaccttaaccgtaccgttacctacccgtaaacccgtcttaaccgaaccgtcgtaacggtaaccgttcgggtaccgttaaccccggtaagtaacgggtttaacttttcggaaccgtttaaacgttacgttttaacttaccgttactaaccggaaccgtaactaacttacggtacgttaacccgttaccccgtaacccctactcccgtaaccgtccggaaccgtaaccggacgaaccgttcgaacgtaccgtaaggtaccgtaaacggaaccgtaacggttagtaccggtacgttaccgaccgttaacccgtacgttacccttgttacccgttacg

SEQ ID NO: 175158 - DNA, 742 bp, Homo sapiens
  misc_feature: GYAE6OF02JYWUQ.21.33.C11.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggcctcccagaaacccaccggagagnttgtgttcgacgcagtcctccgaggccacccttgtctttgtcctcgaggggacagacgcccaccctctccgtggccggggacctaggtacctaaagtttccggttaccccgataaccgttacttacggcccgtagggtaaccccagaccaacggtaaaacccgtcgggacccacggtcctacccccgacgtaaccctccctacaccttaacccaacctaattaacttaccttacctaacggaccgggacccggccgggacctaccgtacccgagaaccgtaggttaccgagtcggagtaggtcgtacggtacgggtacacggtacctaccgtacctacgtccaacgctacgacgacgtacgtagtacggtcgtaccgtaggaattccgtttaagaccgtagttacgttacgttaacgtcgtactacggtaactatacgtaccgtcctaacccgtaccccgtacttacccgtaccgttaccggaaccggtaaccggacctacgaccgttacgacctaagtccgaaggtaaacgcgagtaccggactaccggtactaacgtcgttaacgtcttaccgttacccg

SEQ ID NO: 175159 - DNA, 611 bp, Homo sapiens
  misc_feature: GYAE6OF02F1P35.21.33.C11.1.454.CMB.1.raw
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctggcggggccagtcaaattcgtacccgcgactacttagcctggtaccagcagaaacctggccaggcctcccagtacctcctcactacccaacaatactattacctacgacgggccgcggggcactcccgagacgaggttcaggtggcaggtcgggtcgagggacacgtacttcactcctcaccatcacgcagtacgtggacgccgtagaagtatttagactaagttgtacttactgtcagactaatatcgtacctacccacccccgtatacctaacccgttcggaacccgtaacggaccgtaaccgacgtacgactaacggacgtaacggaaaccgtacgtacgtacggcgtacgaccgtaccgacgttcttacggttcttaacccg

SEQ ID NO: 175160 - DNA, 708 bp, Homo sapiens
  misc_feature: GYAE6OF02HA9XR.21.33.C11.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
  modified_base (438)..(438): a, c, t, g, unknown or other
  misc_feature (438)..(438): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctcccaagaaacccaccggagagattgtgttgacgcagtctccgaggccaccctgtctttgtctccgagggacagacncccacctctcctggcgggccagtactaaattcgtacccgcgtactacgttagcctggtaccagcaagacgccgtggaccacggcctacccgtggttccnctaattcttagtcgtccgtcgggtaccccaggcgggacctacgtcggcctaactccccgaagtacctaggttccaaggtcggacgtagggtcgggtacgacgggaactaggtaccttcacgtccntaacgtataacgttacgacgtacgtacgtcggtactaccgtaggtaacgttacgttacggacttaaaggttcgttaactttacgtacggttacacgtacgtagttaaggtacgttaacgttaccgtaccgttcgttacggttccgggttaccgaacggtaaacgggaacgtaaaggtaacgtaacgtacggtaaacgtacggtacggtacggtacgtaccgtaccgtaccgtaccttacggttaccgttaccttaccgtaccgttacccg

SEQ ID NO: 175161 - DNA, 878 bp, Homo sapiens
  misc_feature: GYAE6OF02F93Q3.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccaagaaaccaccggagagattgtgttgacgcagtctccaggcaccctgtctttgtctccgagggacaggacgcccaccctctccgtaggccggggacctaggtactaaaacgtttcggttaaccccggacgtaacttaccgttacgcccgttacgggtaaccacgccgaaacggtaaaacccgttcgggacccacgggccctaccccgaggtaaccctccctacactacccaactaaacgttacttaactttacctaaccggaccgggggtcccggtaccggggacctaaccgtacccccgaaggtaaccgtacggggtttaccgaagggtccgggacgtaacgggttcggggttaccggtagggggtaaaccctagggttaaccctttccgtaaccgttcccgtaacccgtaacccctaagttacccgaacggtaccgtaacgggacccggtttaggggaacccgtcccgttaaagggtaaaacggttttacttttagggaacctttaaaaggtttcggtttaactttaaccgttacgtaaccggtataaccgttaagttactaccgtaccccttaaccccgaccccgttacgtacccgttaacccggttcggaacccggtaaaggacccgtaacgtacgtaccggacgtaagtaaccgggtaacggaaacccgttacggtggttaacccggcgttaacccgtaccaaccgttaacttccggttccgttacttcccg

SEQ ID NO: 175162 - DNA, 713 bp, Homo sapiens
  misc_feature: GYAE6OF02JSD1K.21.33.C11.1.454.CMB.1.raw
  modified_base (210)..(210): a, c, t, g, unknown or other
  misc_feature (210)..(210): n is a, c, g, or t
  modified_base (310)..(310): a, c, t, g, unknown or other
  misc_feature (310)..(310): n is a, c, g, or t
  modified_base (409)..(409): a, c, t, g, unknown or other
  misc_feature (409)..(409): n is a, c, g, or t
  modified_base (646)..(646): a, c, t, g, unknown or other
  misc_feature (646)..(646): n is a, c, g, or t
  modified_base (662)..(662): a, c, t, g, unknown or other
  misc_feature (662)..(662): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaccaccgagagattgtgttgacgcagtctccaggcaccctgtctttgtctccgaggggaccaggtacncccgacccgtctccgtaggccggggccctagtacctaaatttcggttaaccccgcgtaacttaccgttacgcctcggtaccacgcacggaaacctgacgnggcctaccgagacctccgtcacgtcccaactaatacttccttacgaccgtaggggccccgacgggacctaaccgtccccagtaaccgtcgggtttaccnggttacggacctaggtcgggtccgtagggtacctacggtaccttccgtaacctacgtacccacgtactaccggaatccggtaacgaccgtacggtacgtccctaaggtacgttaactttccggtaacaagtttacggttaaacgttcttaacgttcgtaaacctacgttaaagtctaccggtaccctacccggtaccccttagtcccgtttaacggtaccgtacggaacggtaaacnccgtacgtgactacgngtaacggaactagcgttacggctaccgataccgagttctacgttccgtacc

SEQ ID NO: 175163 - DNA, 792 bp, Homo sapiens
  misc_feature: GYAE6OF02H88M6.21.33.C11.1.454.CMB.1.raw
  modified_base (264)..(264): a, c, t, g, unknown or other
  misc_feature (264)..(264): n is a, c, g, or t
tcagtcgtcgctcgcacgaccggtgctcgatttagagtgagctcgttgggtttggggggagaagagctgctcagtcaggacccagagggaaccatggaaaccccagcgcagcttctccttcctcctgctactctggcctacccaagaaaccaccggagagattgtgttgacgcagtcctccgaggccacccttgtcctttgcctcggagggacagaccgaccctcctcgtccgtggccgggacctagtcctaattcgtacccgnaccttattacgccgttacggtaccagacctaacggaaacccgttggaccgtacggcccttacccgaagacccttcccgactaactacccctaaataaacttacgtttaacttacccgtaacggaccggggtcccggcggacctaaccgtccgaagtaaccggtacgggttacgggttacgacgtgggtcgggttacggtaggacacgtttactcgaccttccgtacacgactacgacgtactacggtagcgtaaccgcgttaagaacgtttattcgacttaagttcgttaagtaccgttagtactaacgacttaacgtacgtccgtaacccgtaacccccgttacccgttaacgtacccgtttaaccccgggttaccgggtaaacccgaccgggtaaaccgaacccggtttaccgaccgtaacggtaaccgtaaacgtaaccgggtaaaaccttcgggtacggtaccggttaactccgggaaacccttagaccggttttaacctttacgggtcccctttaaaccccgg

SEQ ID NO: 175164 - DNA, 850 bp, Homo sapiens
  misc_feature: GYAE6OF02GXQLH.21.33.C11.1.454.CMB.1.raw
tcagtcgtcgctcgcacgaccggtgctcgatttagagtgagctcggttgggtttggggggagaagagctgctcagtcaggacccagagggaaccataggaacccagcgcagcttctcttcctcctgctactctggcctccacgaaccaccggagagattgtgttgacgcagtctcaggccacctgttctttgtctcgagggacagacgccacctcgtccgtggcgggcacgtactaagttcggtaccgacgtactacgtagccgtaggtaccagacgaacgtaaccgtcggacgacggcctaccgacgtaccgtcctacacgtaccctaactaactattaacttccgtaaccggaccggggccggtccgggacctacgtaccccgaaggtacgttacggggtctaacgggtcggacggtaggtttcggggacgtacggggtaaccagttaacccgtttctaaccttcctaccgtaactacgtacgtacgacgtaaggtacgtaccggggtaacgtccgttaagggtaaatttcggtttacgaacgttaaggtttacgtttaaacgtttacgttaccgttaacgtaaggttaaccttaaaggttaccgtaacgttcccccgtaaaccccccggttaaacccgttaaccttacccgggttaaaccccggttcggtaaaaccccgggtaaacggtacccggtaaacccgttaaccgttaccggtaaaccggttaacgtaaaaccggggtttaaaaccgaaacccgggttaaacgttacgggggttaacgttacccgttaccgttaacccggtaacgtttaccttaaccgggttccctttaccgggttaacccc

SEQ ID NO: 175165 - DNA, 607 bp, Homo sapiens
  misc_feature: GYAE6OF02I82Y0.21.33.C11.1.454.CMB.1.raw
  modified_base (324)..(324): a, c, t, g, unknown or other
  misc_feature (324)..(324): n is a, c, g, or t
  modified_base (580)..(580): a, c, t, g, unknown or other
  misc_feature (580)..(580): n is a, c, g, or t
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccacctctccgtgcggggccagtcaaattcgttaccgcgactactagcctgtaccagcagaacctggccaggcctccagactcctcactcacaatatacttctacgacgggccncgggccactcccgagactacggttcaggtcggctggtggtctgggacagacttcgactctaccgacatcgtagacacgacgtaggacgaccgtaggaagtacgtttgactaagtgttaacttaacttgtaacgacgtactaagttactacgtctaccccaccccgtaacgtacctaccggttaccggacccgtaaccgggtaacaacggtaccgtagcgaacgtacgtaacgaaacgtacgtaggttacgcgtacnccgaacctgttacgttcgtattacccg

SEQ ID NO: 175166 - DNA, 707 bp, Homo sapiens
  misc_feature: GYAE6OF02IIW7U.21.33.C11.1.454.CMB.1.raw
tcagtcgtcgctcgcacgaccggtgctcgatttagagtgagctcgttgggtttggggggagaagagctgctcagtcaggacccagagggaacccatggaaaccccagcgcagcttctcttccctcctgctactctggcctcccagaaacccaccggagagattggtgttgacgcagtctcagcacctgtcttgctcgagggcagacgcccaccctctccgtggaccgggccagtcaaattcgttacccgcgacttacgtgcctggaccagacacgaaaccgtcgggaccacggacctccccgagtaccctcctaccgactacccaataactacttactttaccggaccgtaacggggcccggccgggacctacctaccccgaacggtaaccgtaggttaccgagggttgggcgtacggttcggggtcttacgggggacctacggtacctttaccgaccgttacctacccgtaaccgacgtaccgagaccgaagtaccgtacgggacgtcgttaacgaattacgtttgacctaagttcgttaactttagtcgttagacggtaactaacgttataccgccgtaccccaaccccgtacttaccgtacccgttccggaccctaacggacctacgtcgtacgacgtagaaccggtcgtaaaccggtagttcggccggtcgtacgacgtacccgtagtccttgtacccgttcg

SEQ ID NO: 175167 - DNA, 836 bp, Homo sapiens
  misc_feature: GYAE6OF02FNBPS.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctgctcccagaaaccaccggagagattgtgttgacgcagtctcaggcaccctgttctttgtctcgaggggacagacgcccaccctcgtccgtggccggggcctagtacgtaaacgtttcggttaccccgcgtaccttacgttacggccgtcggtaaccgagtacaacggaaaccgtcgggacccgagggtccctacccgaacgaaccccttcccgtacctacctacccctaaactaaagtttacttaactttcccgtaaaccggaccgggggtcccgggaccggggtacctaacccgtaccccgaacggtaaccgtacgggtttaccgtacgggtacggtccgtaagggttcggggttaccggtacgggggtaacctacgggtaccctttaccgtacgtacccttaccgaaccctactaccgaacgtaccgacgggtaccgtacgggacgtacgtaacggtagtttacgtttacgaacttaagtttacggttaatttaaccggtgtaacctaggtaacctaagtttacctcggtacccttaccccgaacccccgtttactaccccgttaaccggttaccggtacccggaaaacggacccgtaaccgaccgttacgtacgaacggtaacgtaaaccgggaaaccggtaacgtcgggttacggtccgtaccaccggtaccttacgttactccggtttacttaaccg

SEQ ID NO: 175168 - DNA, 816 bp, Homo sapiens
  misc_feature: GYAE6OF02IX423.21.33.C11.1.454.CMB.1.raw
  modified_base (799)..(799): a, c, t, g, unknown or other
  misc_feature (799)..(799): n is a, c, g, or t
tcagtcgtcgctcgcacgaccggtgctcgatttagagtgagctcgttgggtttggggggagaagagctgctcagtcaggacccagagggaaccatggaaacccagcgcagcttctcttcctcctgctactctggctcccagaaaccaccggagagattgtgttgacgcagtctccaggccacctgtctttgtctccgaggggacagtacgccctacccgtcttccgtacggccggggtcccaaggttacctaaaagtttccggttaaccccggacgtaaccttaacgttacggaccgttcgggtaacccaaggtaccaaacggaaaacccgttcgggacccaacggtcctacccgaacggtaacctccctacaacgttacccaaactaatttaacgtactttacgtaacgtacggggaccgtaccgggactaacccgtacccgaaggtaaccgttaacgggtttcaacgggttccggacgtaacggttcggggtaccgttacggggaacacggtaaccttccgacgttccgtacaaccgtactacgaacgtaccgaacggtacgtacgggactacccgttaagtaaacggtttcgtttagaaccgttaatttacgtttaacgtttaacccttaggacgttacgaaaccttaattacgtacgtaccctaccccggaaccccttacgaacccgttcccgttacggaaccccggtaacggtaccaaccggttacgtccgacgtaacgtaacgtaaccggtaaaccgtacggttaacggacggttccacgtaccaaccgtttntaacgttcgtacctacg

SEQ ID NO: 175169 - DNA, 653 bp, Homo sapiens
  misc_feature: GYAE6OF02G6C57.21.33.C11.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagagtgagctcgttgggttttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtcctccgaggggacagacgcccaccctctcctggccggggccagtacctaaattcgttaccccgcgaacttacttacgcctaggtaccagccaagaaacctggccacggcctcccagacctcctacactccaacaatactacttacctacgacgggccgcgggcctacnccgagacgtacggttcaggtcggctaggtgggtcagggacagtacttcgactctacaccatccagcgacgacgtggacgtcgtaggtaacttagtttcgacgtaattacggttaacttacgttaggtacacgtactaagttctacacccgtaccgtacccccgtatccctaaccggtttacccggaaccggtaacgggaacctaccgaaccgtacgactaacggaacgtaacggaaaccgttagtacggtaggtcctacggacctaccgtactttcgtccgttagttccc

SEQ ID NO: 175170 - DNA, 630 bp, Homo sapiens
  misc_feature: GYAE6OF02FNTBV.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacagagccacctctcctgcggggccagtcaaattcgtacccgcacttacttagccttggtaccaggcagaaacctggaccaggcctcccagacctctcactccacaatatacttctacgagggccgcgggcactcccgagacgtaggttccaggttcggacaggtgggtacgtagggaccaaggtacttcaacgttctacaccctagtacgacgcgaagtacgtacggacgaccgttaaggaaagttagttttagactaaagttagttaatttacgttaggtactacggactaaatcgtacggtaccttacccaaccccgtatcctaccgttccggaaccgtaacggaccaacgtactagtacgacgtaacgtacgaaacgtactaggtcgtacgttacgacctacgtacttacgtacgttactaacc

SEQ ID NO: 175171 - DNA, 884 bp, Homo sapiens
  misc_feature: GYAE6OF02HCKK1.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggcctccagaaaccaccggagagattgtgttgacgcagtctccagcaccctgtctttgtctcgaggggacagacgcccacctctcctggcgggccagtcaaattcgtaccgcgactacttagcctaggtaccagacaacgtaaaccgtcggccacggcctacccacgacctaccgtacactaccaactaaattactaacgttaccgtaacggaaccggggtcccggaccgggtaccaaccgtacccgaaggtacctaacgggttccgtaaggtcgggacgtaacgggtttcggggtaccgttacggggaaccgtaacggtaccctttaccgtaaccttccgtaacccgaaaccctaacgtaccctaacggaccgtaacggtaaccggtacgggtaacggtaaccccgttaaaggtaaaacggttttagttttaaccgggtaaacttaaacgttttaacgggtttttaaaccgtttaacgtttccggtaaacccttaacgggttaaccttaaaacgttacgttaacccggttaaccccgttacccccgtaacccccccgttacgttaaccccgttacccgggtttaccggaaacccgtaaaccgggggtaaccctaacgggtaccgttaccggaaccgtagggttaaaacgtaaaccggtaaaaccggttacgggttaaaccgggttcggtaaccggttaaccggacccgtaaccgttaaccggtttcttaccgggttaccctttaacccgg

SEQ ID NO: 175172 - DNA, 689 bp, Homo sapiens
  misc_feature: GYAE6OF02JLN8E.21.33.C11.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagagtgagctcgttggggtttgggggggagaagagctgctcagtcaggacccagagggaaccatggaaacccagcgcagcttctcttcctcctgctactctggctcccaagaaaccaccggagagattgtgttgacgcagtctccaggccaccctgttctttcgtctccgaggggacagacgcccaccctctccgtcggcgggacctagtactaaactttcgttacccgcctacttacttacggcctacggtaccagtaccaacggaaaccgtcggacctacggtcctaccacgacctcctcactaccaactaatnttacttctacgacgggcccggacggaccgtacctacccgacggtaacgtacggttacgtacggttcggacgttaggtcggggtccggtagggaccgtaacgttacgtacctacgttactaccgaactacgtacacggactacgacgtacgacgtcgtacggtaagttctttcgactaagttacgttacgttacgtacgtacgtaacgtactaactatccgacctacccgtacccctacgtcctaacccgtcggaacccgtaacgacctacgacgtacgacaagtacgtaaccgaacgtacggtcgtaccgcgtacacctactactaccgttcgttctccg

SEQ ID NO: 175173 - DNA, 693 bp, Homo sapiens
  misc_feature: GYAE6OF02FT84W.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcacctgtctttgtctcgagggacagacgcccaccctctcctggccgggccagtcaaattcgtacccgcgactacttagcctaggtaccagcaacgaaacctggaccaggcctacccgagacctcctacactaccaataatacttacttactacggacgggccgacgggcactacccagacgtacggttacaggtcggacgtaggtgggtccgtagggactaggtaccttcaccttccgtacacctacgtacgacgacgaacgtacgtaggaccgtccgtaaggaacgtttagtttacgaacttaagttacgttaactttacgttcgtaccgtaagtaactaaattacgtccgtaccccgtaccccgtaacccccgtactaccccgttaaccggttaccggaacccgaaacgggtaacctacggtacctacgacgtaacgtaacgtaaacggtaaaccgtacgttaggtacgaccgtacgtacctaccgttccgttacttcgttaccttacccg

SEQ ID NO: 175174 - DNA, 780 bp, Homo sapiens
  misc_feature: GYAE6OF02G8M3J.21.33.C11.1.454.CMB.1.raw
  modified_base (448)..(448): a, c, t, g, unknown or other
  misc_feature (448)..(448): n is a, c, g, or t
  modified_base (617)..(617): a, c, t, g, unknown or other
  misc_feature (617)..(617): n is a, c, g, or t
tcagtcgtcgctcgcacgaccggtgctcgatttagagtgagctcgttggggtttgggggggagaagagctgctcagtcaggacccagagggaaccatggaaaccccagcgcagcttctcttcctcctgctactctggctcccagaaaccaccggagagattgtgttgacgcagtcctccaggccaccctgtctttgtctccgaggggacagacgcccaccctcctcctggccgggccagtacaaactttcgttacccgcgtaaccttacgttacggcccgttacggtacccaacgacgtaaacgtaaacccgttcgggacccgtaggtcccttaccccgaagtaccctacctacaaccttacccaactaaattaacgttactttacctaaccggaccggggtacccggccgggaccaaccgttaccccgaggtaacctacgggtttanacgggtcgacgtagggttcgggtcgtacgggactacggttacttaccgacttcgtaacccactatcgaaacgtcaacggtacgacggtacgtacgtagtaacgttacgtttacgacttaagttacgttaactttaacggtacgtacgaacgtactaagttacgtacccnccccgttaacccctaacccccgtacttacccggttaacccgtaccggaacccggtaacggtaccgaaccgtaccgacgtaacgtaggtaccgtaaaacggtaacctaacggtacgttaccgtacgtacgaacctaccgtaactccgttacgttccttaacccg

SEQ ID NO: 175175 - DNA, 808 bp, Homo sapiens
  misc_feature: GYAE6OF02GJ8FY.21.33.C11.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagagtgagctcgttgggtttggggggagaagagctgctcagtcaggacccagaggaaccagtggaaaccccagcgcagcttctcttcctcctgctactctggctccaagaaaccgacggagagatttcgtgttagacgctagtctccaggcctaccctgttctttcgtctcgaggggacagacgccacctctcgtcggcgggtccagtactaaacgttcgtacccgngtaacttactacgccgttagtaccagtaccgaacgtaaacccgtggtacccaaggtacctccccaaggtaccccttccgtactcgttaacccacgtaaattcttactttaccgacggaccgggaccggtacggacaacgttcccgaagtaacctcggttacgaggtcggactaggtagggtcctagggacctagggacctttcgaacttccggtaacctactactaccgaacggttccaaacggtacggtcgtacgtaccgtaagttaaacggttatttaccggtaacgtaaactttacggttaacgtttaagtttaccgtacgtaaacggtaacctttaaaggttacgttaccggtacccgttacccccggtaaccccgttaccggttaacccgttaccggtttacccgggaaaaccgtaacggaacccgtaaacgttccgttaaccggaccggttaaacgacggttaaaccggtaaaaccgtggtaccgttccgggacttaacccgacgttacccgtagtttaaccggtttcgtaccttaacccgg

SEQ ID NO: 175176 - DNA, 776 bp, Homo sapiens
  misc_feature: GYAE6OF02GDKRF.21.33.C11.1.454.CMB.1.raw
tcagtcgtcgctcgcacgaccggtgctcgatttagagtgagctcgttgggtttgggggagaagagctgctcagtcaggacccagagggaaccatggaaaccccagcgcagcttctcttcctcctgctactctggcctccagaaaccacggagagtattgtgttagacgcagtctccgagccacctgtcgtttgtctacgagggacagacgcctaccctctccgtaggccggggccagtacaaagttcgttacccgcgtacttacgttagcctcggaccagcacgaaacgtggaccaggcctacccagactcctacacgtaccaacaattacgtaacttacgtacggtacgggcccgcgggacgtaacgtcccgaagacgtacggtttacgaggttcggtcgaagggtcgggttactaggggacctaggtaacttccaacgtacctacctaaccgtaacgtacaaccggtacaggaaccgttcgggaacgttaccgttacgggtaaagtttaacggttttacgacgttaaatttagttaacttacgttcggtacctaacggtataaaccgttatccggtaccccttccggtaaccccccgtacgtttaaccccgtaaccccggttacccgggaaccggtaaacccgggtaaacctcccggtaacgttccggtacaaccggtttaaccgtaaacggttaaaccgaacgggtttcccggtaacggtaccggtaccgttaaccgtaacccgttacgtacgttaccgtttcccgtttaacc

SEQ ID NO: 175177 - DNA, 582 bp, Homo sapiens
  misc_feature: GYAE6OF02IZ2XE.21.33.C11.1.454.CMB.1.raw
tcagtcgtcgctcgcacgaccggtgctcgatttagagtgagctcgttgggtttgggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgaggggacagacgcccaccctctcctggccggggccagtcaaattcgtacccgcgactacttagcctggtaccagcagaaacctggccaggctccagactcctcatccacaatatattctacagggccgcgggcactcccagacgtaggttcagtgcaggtggcgtagggacagacttcactctcaccatcacgcagtactggacgtcctaggaagtatttcgactaatagttattacgtgttacagtactaatatcgaccttcccacccccgtatacccgtaccgttccggaaccgtaacgggaccacgtacgtcgacgaagtacgaagtaaaccgaacgttcggtagtcgtacgccaacgtacttcgtcgttaccttacccg

SEQ ID NO: 175178 - DNA, 868 bp, Homo sapiens
  misc_feature: GYAE6OF02H9XM0.21.33.C11.1.454.CMB.1.raw
  modified_base (63)..(63): a, c, t, g, unknown or other
  misc_feature (63)..(63): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
tcagtcgtcgctcgcacgaccggtgctcgattttagagtgagctcgttgggtttggggggganaagagctgctcagtcaggaccagagggaaccatggaaaccccagcgcagcttctcttcctcctgctactctggctacccagaaaccaccgggagagtattgtgttgacgcagtctcgacgcaccttgtctttancnccggagggacagacgcccacctcctcgtcggccgggtaccagttactaacgtttcggttaaccccgacgtaaccttacgttacgaccgttacggtaaccgagtacgaaacgtaaacccgtcggaccgtacggtaccgtacccagtaccttacccgactaaccgtaccctaaacaaacttaagttaacctttaccgtaaccggtaacggggtaccggtaccggtaccctacgttacccaaaggtaccgtacggttaactaggtacggacgtagggtacgggttacgtggggaactacggtaaccgttacaaccgttcctacgaacctacggttaaccacgtaaccgtaacgtacggttacggtaaccgggtaacgtttacggtaaacggttttagtttacggaacgttaaacgtttacggttttaaacgtttaaaccggttcggtaaaccggtacgtaaaccttaaagtaccgtaaccgtacccgttaaccccgtaacccccggttacttaaccccgtacccggttacccgggaaaccgtaaaccggtaccgtaaacgtaccgtaacgtaccgtaacggtaaccgtaaaccggtaaaccgtaacggttcgggtaacgttaccgcccggtaactaccccgttaagttccggttaccttaccgttaacccgg

SEQ ID NO: 175179 - DNA, 812 bp, Homo sapiens
  misc_feature: GYAE6OF02FO7F3.21.33.C11.1.454.CMB.1.raw
  modified_base (392)..(392): a, c, t, g, unknown or other
  misc_feature (392)..(392): n is a, c, g, or t
  modified_base (639)..(639): a, c, t, g, unknown or other
  misc_feature (639)..(639): n is a, c, g, or t
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccgagggacagacgcccacccttctccgtcgggccggggccagtcctaaagtttccggtaccccgacgtaaccttacgttacggcccgttaggtaacccaggacctaaacggaaacccgtcgggaccctacggccctacccgaagtaccctccctacacctccaactaattacttacgttccaccggacggggcccncgggtaccacgtccccgaaggtaccgtacgggttacgacgggtcgggtaccgtaaggggtttcggggtaccgtacggggtaacctaaacggtaccctttaccgtacgttaccccgaaccgtaaaccctcgttaaccggaaccggtacaccggtaacgggtacgggtaccgtaccggtaaggtaacgtttacttttacggaccttaagtttaccggtaatttaccgtcgtacgaactacgtaaacgtntccgtaccctacccgaccccgttattacccgtaccggttacccgaaccgtaaagtaccccgtagtacccgtacgtaccgaacgtaaacggttaaccggaaaccggttacggtcggttaacccggcgttaacccggacctttaaccgtaccgtttcgttccgttacgttacccg

SEQ ID NO: 175180 - DNA, 717 bp, Homo sapiens
  misc_feature: GYAE6OF02GRWAJ.21.33.C11.1.454.CMB.1.raw
  modified_base (212)..(212): a, c, t, g, unknown or other
  misc_feature (212)..(212): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtgagctcgttgggtttggggggagaagagctgctcagtcaggacccagagggaaccataggaaaccccagcgcagcttctcttcctcctgctactctggcctcccagaaaccaccggagacgattcgtggttgacgcagtctccgaggcaccctgtctttgtctcgagggacagngcccacctctccgtgcgggccagtactaattcgtacccgcgacttacttacgcctggtaccaggccaagaaaccctggaccnggcctcccgacgactccgtcactacccgacaatatactctacggacgggtccgcggcctacgtacccagtacgacggttcagttggacctaggtcgggtccgagggacctagacttcaccttctaccgcctataccgacgtcacggtatacgggctacgtaggtaattcgtttacggaactaagttacgttaattaccgttagtaccgaacgtaactaaagttactccggacccgtttacccccgaaacccccgttacgttccccgtaaacccggtttccccgggaaccgggtaaaaccggggacccttaaacggtaccgttaccgggtacctacggtaaaccggtaacggtaaaacccgttacggtaccggttaccggtaactccggtacgtaacctacgttccggttacggtacttacccg

SEQ ID NO: 175181 - DNA, 817 bp, Homo sapiens
  misc_feature: GYAE6OF02IQGXR.21.33.C11.1.454.CMB.1.raw
  modified_base (62)..(62): a, c, t, g, unknown or other
  misc_feature (62)..(62): n is a, c, g, or t
  modified_base (208)..(208): a, c, t, g, unknown or other
  misc_feature (208)..(208): n is a, c, g, or t
  modified_base (532)..(532): a, c, t, g, unknown or other
  misc_feature (532)..(532): n is a, c, g, or t
tcagtcgtcgctcgcacgaccggtgctcgatttagagtgagctcgttgggtttggggggganaagagctgctcagtcaggaccccagagggaaccatggaaaccccagcgcagcttctcttcctcctgctactctggcctcccagaaaccacggagagtattgtgttagacgcatctccagcaccctgtctttgtctcgagggacagngacccacctcctcctaggtccggggaccaggtacctaaactttcgttaccccgacgtaacttacgttacgacccgttaggtaccacggacctaaggaaaacccgttcggacccgaaggcccttacccccgaagtaaccctccttaccacttaaccccaataaacgtttagttactttaccttaacccggacgggggtccgtacgggggaccctacctaacccggtaacgtaaccgtgggttacctagggtaacggtcgtaaacggtttccgggggccttaacgggggaaccgtagttaccgttaccggaacttccggtaaaccnccgtaacgtaccgacgaacgaacgacgttacggtacggaaccccttaggtaaacgttaacggttttcggacttaaaaccggttacggtttaaacttacgttaagtacgaacggtataacgttaagacgttacctaccaacccccgattccctacgttaccggaaccgtaaggaacccgttaacgacgttagacccgtaagtaaccgaacggtaaaccgtaaccggtggtaccggtaacgtacccgtaccgtaaacccggtattaccggttaccttacgttacccg

SEQ ID NO: 175182 - DNA, 845 bp, Homo sapiens
  misc_feature: GYAE6OF02FNG36.21.33.C11.1.454.CMB.1.raw
  modified_base (297)..(297): a, c, t, g, unknown or other
  misc_feature (297)..(297): n is a, c, g, or t
tcagtcgtcgctcgcacgaccggtgctcgatttagagtgagctcgttaggtttgggggagaagagctgacttcaggtcagggacccagaggaaccactagggaaaccccagcgctagacttctccttcctcctggctactctcggctcccagaaaccacgtagagattagtggttcgacgtctacgtctccaggtcaacccgttggtcctttgcctaccgtagggtacagtacgccgtaccctagtccctagggccgggacctagtcaaattcgtacccgcgaaccttacggttacnccttaggtacccacgtcgacgtaaaccccttggacccaggacctacccgacgtaccttaccgtacgacttacccgaataacgtacgttaacctttcggtaaccgaacggggtccccggtacggggtacctaacgttaccccgtaacgttaccgtaacgggttttccaaaggtttcgggtaccgtaggtttacggggtaccggttacgggaacgtaaccggtaaacgtttccgacttacctaaccgccttaacgccgaagtaccagtaccgttaggacgtccgtaagtaacggttacgttttaggaccgtaagttagttaaccgtttacggtttacgtaccgtaaggtaacttaaaacgttacgttacccgtaacccgttaccccggtaaccccgttaacgtacccggttaacccggtttaccgggaaacccttaaaggggaacccctaacggtttccgaacgttaaccgtaacggtacgtaaacggaaaccgttaaccgtggttaccgtacgtacgtacctaacgtactaccgttacgttaccttacg

SEQ ID NO: 175183 - DNA, 716 bp, Homo sapiens
  misc_feature: GYAE6OF02FS3XI.21.33.C11.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagagtgagctcgttgggtttgggggagaagagctgctcagtcaggacccagagggaaccatggaaaccccagcgcagcttctcttcctcctgctactctggctcccagaaacccaccggagagattgtgttgacgcagtctccgaggggacagacgcctacccgtctccgtggcggaccagtcaaattcgttacccgcgaccgtactacgccgtagtaccacgcaagtaaaccgtggaccgaggtccnccgagacctccctagactaccgaacaagtactacgttcctaacgacggtcccgacggactacgtccccgtaagtaccgtaggtttccgaaggtcgaccgtaacgggttggggtacctcggggtaaccaggttaacccgttccgaacgttccgtaccgaaccgtacgtacacggtacaacggtacgtacggaacgtcccgtaagaaccggttatttacggacttaagtagtacttaaccgtgttaccgacggtaactaattacgtcgtacccgttacccgtaccccgtacgttacccgtaccgtaccggaccgaacggcccaacgtaccgtcacgtaacgtagtaaccgaaacgtacgtgtaccgtctacgtaccaaccttacgtacgttcgtacctacgtacttcccgaacccgtctaagttccgtacgtaccgg

SEQ ID NO: 175184 - DNA, 786 bp, Homo sapiens
  misc_feature: GYAE6OF02FYB56.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctcccagaaaccaccggagagattgtgttgacgcagtctccaggccacctgtctttgtcctccgagggacagacgcccaccctctccgtggccgggccagtactaaagttcgtacccgcgaacttacttacgcctacggtaccagaccaagaaacctggccaggcctacccgagacctccctacactccaacaattactaacttcgtaacgacgggcccggcgggacctactaccccgagaccgtagggttcagttcggacctaggtcgggtacgtgggactagtcttccacgtctaccaccatcgaacgccaggtaccgtagggacgtaccgtagtaacgttacgttttcgaccgttaaagttgttaaccgtttacgttacggttaacccgtaagttaaccctaaagtttacgtaccgggttacccctttaacccccggaaccccccttaagtttcccccgttaaacccggttcccgggtaaacccggtaaaaccggtacccgtaaacccggttaccgtacccggttaaccgtaacggttaacccggttaaaggaaaaccccggttacggttaaccgggtaaccggttcccgtaaccggtaaccgttaaccccgttatttacccggttaccggtttcccgtttaaccccg

SEQ ID NO: 175185 - DNA, 685 bp, Homo sapiens
  misc_feature: GYAE6OF02HFHGY.21.33.C11.1.454.CMB.1.raw
  modified_base (197)..(197): a, c, t, g, unknown or other
  misc_feature (197)..(197): n is a, c, g, or t
  modified_base (364)..(364): a, c, t, g, unknown or other
  misc_feature (364)..(364): n is a, c, g, or t
tcagtcgtcgctcgcacgaccggtgctcgatttagagtgagctcgttgggtttgggggagaagagctgctcagtcaggacccagaggaaccatggaaaccccagcgcagcttctcttcctctgctctctggctccagaaccacgagagatgtgtgacgcagtctcaggctacccgtgttctttgtctccgagggacncggacgccaacctcctcgtcggcgggccagtactaaagttcgttacccgcgacttactacgcctggaaccgactaacgaaccgtgaccgacggcctacccgacgaccctccttacgactaccaacaattaactactttaccgacggacgggtaccgacgggaccacncccgaagtaccgtagttcagggttacggcgtaacgggtcggttacggtacgggaccttaggtacctcgtaccttcctaaccaccgtactacgcgctaacgaccggtagccgtaccgtaggaaagttacgttgaactacggttacgtacgtttaactcggtactagtactaattaccgcggtaccctaacccccgttaccgtacgttcccgtaaccgtttaccggaacgaaccgggtacctaaacgtaccgtcggactagtaccgaaataaccgttacgtgacctcggttacaccggcctttaacgtccttgtaccttaccg

SEQ ID NO: 175186 - DNA, 992 bp, Homo sapiens
  misc_feature: GYAE6OF02FSR93.21.33.C11.1.454.CMB.1.raw
tcagtcgtcgctcgcacgaccggtgctcgatttagagtgagctcgttgggtttggggggagaagagctgctcagtcaggacccagagggaaccatggaaaccccagcgcagcttctcttcctcctgctactctggctccagaaaccacggagacgtattgtgtgacgcagtctcaggccacctgtctttgtctcgagggacagacgccacctctccgtgccgggcacggtctaaacttcggttacccgcgtaacgtaccttaggcccgttacgtaacccgtacgaccgtaacggtaaccccggtcggtaccccaacgggttacccttacccccggaacgttaacccgttccccttaccgtaaccgttacccctaaactaaaacgtttacgtttaaaccttttcccggttaaaccgggaaccgggggttcccggaaccggggttccgtaaacccgttaaccccgacggggtaaaccttacggggtttacccgaaggttccgggggtcccgtaaacggggtttacgggttcgttaaccgggggacgtacgggttacctttaaccgaccgttacctacccgaaacccgtacttccggaacggcctacgggtaacgtacgggtaaccgggttaccgtaagggttaaaccgttacgttttaacgaacccgtttaaaggttagttaacccgttttagtacggtaaccgttaacggaaccgttaacgttaaccggttacggtaacccttaacccccggtaaccccggttaccgtttaaccccgtttaaccgggttaaccccgtaacccggggttaaaccggtaaacccgtaaccggttaaccccggtaacggttacccgggtaaaacggtaacccggttaaacgggtaaaaccccgggtaaacggttttccggtaaccgggtttacggtaaccccgggtaccgttaaaccccggtaacccggttttaacccggttcccggttttacccggtttaacccg

SEQ ID NO: 175187 - DNA, 188 bp, Homo sapiens
  misc_feature: GYAE6OF01BIIOG.43.75.G09.1.454.CMB.1.raw
  modified_base (187)..(188): a, c, t, g, unknown or other
  misc_feature (187)..(188): n is a, c, g, or t
tcagtgtgagtagtcacgaccggtgctcgatttagtatagacatcagggtcagcctccaccaagggcccatcggtcttcccctggcgccctgctccaggagcacctccgagagcacagcggccctgggctgcctggtcaaggactacttccactactcacactgagcgggctggcaaggcgcatagnn

SEQ ID NO: 175188 - DNA, 218 bp, Homo sapiens
  misc_feature: GYAE6OF01D7E8B.43.75.G09.1.454.CMB.1.raw
  modified_base (190)..(218): a, c, t, g, unknown or other
  misc_feature (190)..(218): n is a, c, g, or t
tcagtgtgagtagtcacgaccggtgctcgatttagtatagacatcaggggtcagccgtccaccaagggcccatcggtcttccccctggcgccctgctccaggagcacctccgagagcacacgcggccctgggctgcctggtcaaggactacttccactactcacactgagcggctggcaaggcgcatagnnnnnnnnnnnnnnnnnnnnnnnnnnnnn

SEQ ID NO: 175189 - DNA, 193 bp, Homo sapiens
  misc_feature: GYAE6OF01EFK7B.43.75.G09.1.454.CMB.1.raw
  modified_base (187)..(193): a, c, t, g, unknown or other
  misc_feature (187)..(193): n is a, c, g, or t
tcagtgtgagtagtcacgaccggtgctcgatttagtatagacatcagggtcagcctccaccaagggcccatcggtcttcccctggcgccctgctccaggagcacctccgagagcacagcggccctgggctgcctggtcaaggactacttccactactcacactgagcgggctggcaaggcgcatagnnnnnnn

SEQ ID NO: 175190 - DNA, 189 bp, Homo sapiens
  misc_feature: GYAE6OF01AGHK8.43.75.G09.1.454.CMB.1.raw
  modified_base (187)..(189): a, c, t, g, unknown or other
  misc_feature (187)..(189): n is a, c, g, or t
tcagtgtgagtagtcacgaccggtgctcgatttagtatagacatcagggtcagcctccaccaagggcccatcggtcttcccctggcgccctgctccaggagcacctccgagagcacagcggccctgggctgcctggtcaaggactacttccactactcacactgagcgggctggcaaggcgcatagnnn

SEQ ID NO: 175191 - DNA, 189 bp, Homo sapiens; identical to SEQ ID NO: 175190
  misc_feature: GYAE6OF01A3WB6.43.75.G09.1.454.CMB.1.raw
  modified_base (187)..(189): a, c, t, g, unknown or other
  misc_feature (187)..(189): n is a, c, g, or t

SEQ ID NO: 175192 - DNA, 117 bp, Homo sapiens
  misc_feature: GYAE6OF02JBGUA.43.75.G09.1.454.CMB.1.raw
  modified_base (114)..(117): a, c, t, g, unknown or other
  misc_feature (114)..(117): n is a, c, g, or t
tcagtgtgagtagtcacgaccggtgctcgatttagtatagacatcagggctatgcgtcttcatcttcccgccatctgaactactcacactgagcgggctggcaaggcgcatagnnnn

SEQ ID NO: 175193 - DNA, 153 bp, Homo sapiens
  misc_feature: GYAE6OF01A7JLK.47.52.E08.1.454.CMB.1.raw
  modified_base (113)..(153): a, c, t, g, unknown or other
  misc_feature (113)..(153): n is a, c, g, or t
tcagagctcacgtacacgaccggtgctcgatttagtcgagctctctcggcgggctgcctggtcaaggactacttcctacgtgagctcctgagcgggctggcaaggcgcatagnnnnnnnnnnnnnnnnnnnnnnnnnnnnnnnnnnnnnnnnn

SEQ ID NO: 175194 - DNA, 600 bp, Homo sapiens
  misc_feature: GYAE6OF01CVK72.47.52.E08.1.454.CMB.1.raw
  modified_base (455)..(455): a, c, t, g, unknown or other
  misc_feature (455)..(455): n is a, c, g, or t
tcagagctcacgtacacgaccggtgctcgatttagtcgagctctcagagagaaagggggcatcacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaaggagccgtgggtcctcgggtgaaggtctccgtgcagggtcttcgtggaggcaccttcggccacctacactagtcggctgggtcgcgacacgtccccgtggaccaagggtcttggagtggatgggcgagtcattcctattcctagactaaaaacaactacgctaacgagtaaacgttccggaataggtaacgtttaccgtttaccgacggaacgaactccgaacgaagaacagacctagatgganctagacgcgacctgacgatctaggaccgacgacggtacctaagtttacttaacgtagtaaacaaaagtcttacgttggtacgaaggggtaaactacccggaaggaccctaggaaccgaccgaacggtcggggaccctaaacgggg

SEQ ID NO: 175195 - DNA, 612 bp, Homo sapiens
  misc_feature: GYAE6OF01CZMS1.47.52.E08.1.454.CMB.1.raw
  modified_base (363)..(363): a, c, t, g, unknown or other
  misc_feature (363)..(363): n is a, c, g, or t
  modified_base (431)..(431): a, c, t, g, unknown or other
  misc_feature (431)..(431): n is a, c, g, or t
tcagagctcacgtacacgaccggtgctcgatttagtcgagctctcagagagaaagggggcatcacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaaggagccgtgggtcctcggtgaaggtctccgtgcgagggtcttcgtgggacggctaccgttcggccacctacactagtcggctggggtcgcgacgacgtcccgtggacgagggtcttggagtggagtgggcggagtctacttcctattcctanactaaaaacaactacgcacagtaacggtccggatagacgtttacgtaccgacggacaactaccacganaacagtaccagagtggagcagacgcgaccgtagagactcgacggaccgtacgacggtacccttaagttttactaacgtagtaaacaaaagttgtacgtttacggacggtaaaggggtaaacctaccggaaggtacccgtacggaacccgaccgaacgggtccgggggaaccctaaccgggg

SEQ ID NO: 175196 - DNA, 639 bp, Homo sapiens
  misc_feature: GYAE6OF01DB47S.47.52.E08.1.454.CMB.1.raw
tcagagctcacgtacacgaccggtgctcgatttagtcgagctctctcggcggggggggtgccgcagccatggcctggaccgctctccttctgagcctccttgctcactttacagtttctgtggcctcctttgacctgactcagccactctcagtgtccgtggccctgggacagacggccagacttacctggtgggggaatcaacattggaacgtaaaatgtgcactggtaccaacagaagccaggccaggccccctgtcctggtcatctaataaggataacaaaccggccctgtaggactccctgaacgtattcctctggcctccaagttcggaacaaccgaccggcccaccctagacccatccagcaagacgacccgaaggtccggaagagtggagctagtacttatttctagttactaaagttgggactacgttccgtacccgtgtcgtcggttacgttccgggcgaccgaacggacccgtaagtccgtaccggtaccgttacctaacgtccaaccgacccgaacggtccgtacccgcccccgttcggtaccctccgttccgtcccgttccccgcccccttccgttccgtacgtcgtacgtcctcgtcggacggccggtcgacggcgacggcgaacg

SEQ ID NO: 175197 - DNA, 559 bp, Homo sapiens
  misc_feature: GYAE6OF01EOMQ4.47.52.E08.1.454.CMB.1.raw
  modified_base (298)..(298): a, c, t, g, unknown or other
  misc_feature (298)..(298): n is a, c, g, or t
tcagagctcacgtacacgaccggtgctcgatttagtcgagctctcagagagaaaggggcatcacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaaggagcctgggtcctcggtgaaggtctcctgcagggcttcgtggaggcaccttcggcacctacactatcggctgggtgcgacagtccccnggacagggcttgagtggatgggcgagtcattcctattcctgactaaaacaactacgcacagaagttccggacagagttacgttaccgcggacgaatccacgagaacagcctacatggagctgacgcgacctgacgtatctagacgacgacggtaccaatttactacgttagtaactaaaagtacttcgttagtacgaaggggtaactacccgaagggtaccctaggaacccgtacccgacggtcggggcccgtaaccgggg

SEQ ID NO: 175198 - DNA, 786 bp, Homo sapiens
  misc_feature: GYAE6OF01EXZA4.47.52.E08.1.454.CMB.1.raw
  modified_base (749)..(749): a, c, t, g, unknown or other
  misc_feature (749)..(749): n is a, c, g, or t
  modified_base (780)..(780): a, c, t, g, unknown or other
  misc_feature (780)..(780): n is a, c, g, or t
  modified_base (783)..(783): a, c, t, g, unknown or other
  misc_feature (783)..(783): n is a, c, g, or t
tcagagctcacgtacacgaccggtgctcgatttagtcgagctctctcggcggggggggtgccgcagccatggcctggaccgctctccttctgagcctccttgctcactttacagtttctgtggcctcctttgacctgactcagccactctcagtgtccgtggcccgtgggacagacggccagtaccttaccgtggtaggggaatacaactagttaggtaaacgtaaaagtgtagactaagtacggtaaccaaacgagaacgccgacggccgacggccctgtccgtggtacatacgtaagtaacggactaaccgaaacccggtccctacgtacgggtacctcccgtaggtaaccgttacttcctcgtacggtaccctacgtaacgttacggtacggaaccgaccggtaccccaaccccgttacggaacccgtcgaacggaccgggtacggggtaccggtacggggtacggggtacggtacggtacgggtttaccgtttaagttttacggtttttacggtacgggtagggttacggtagggtaacgttaaacgttttaggttttacggtacgttaagttagggtttcggttttacgggtaccggggtacggtaacggggtaaccgtaacgggtaccgttaccgggtcccggttaccgttccgggaccgtacggaaccccgtaggtcccgttcccgaccccggttcgttccctaccgttccgttacccgtcccctcctccgtacgtcgtacncgtccgtgacgcggcgacgtggacgtagcanagngcg

SEQ ID NO: 175199 - DNA, 748 bp, Homo sapiens
  misc_feature: GYAE6OF01A7K4V.47.52.E08.1.454.CMB.1.raw
  modified_base (191)..(191): a, c, t, g, unknown or other
  misc_feature (191)..(191): n is a, c, g, or t
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (546)..(546): a, c, t, g, unknown or other
  misc_feature (546)..(546): n is a, c, g, or t
tcagagctcacgtacacgaccggtgctcgatttagtcgagctctcagagagaaaggggcatcacataacaaccacattcctcctctaaagaacgcccctgggagcacagctcatcaccatggactggacctggagttcctctttgtggtgcagcagctacgaggtgtccagtctcaggtgcagcgtggtcncagtcgtgggctgaggtgaaggcgccgtgggtcctggtagacgtctcgtagcgtaggtcttcgnggacgtcctacccgttcggacctaaccgtacactacgtcgcgtgggtcncgacctcggtcccctaggacgtaaggtcgttaggaggtggaggtcgggacggtagtaccgtcgtttaccgttacgttccgtaaggtaaacctaaaaacctaaccgtaccgacgtaaccgtaaacgggttaacccggttaccgggaactaacgggttaacggttttaacccggttaacccggacggtaaccgtaactacccggaacggtaacgaaaccgtcgtaccctaggtacgtaggtacncgtagaccgtcgtacgtagtacgtacgcgttaccgaacgtccgtacgttaccgttaacgttttacgtaaccttaaggttaaaccgaaaagtttccgttacggttaaccgtacgggtaaaacgggtacccgttaaccgaaccgggttacccgtacggtaaacccgacccgggttacgggtacccgggtcccggtaaacccggg

SEQ ID NO: 175200 - DNA, 811 bp, Homo sapiens
  misc_feature: GYAE6OF01E2UUA.47.52.E08.1.454.CMB.1.raw
tcagagctcacgtacacgaccggtgctcgatttagtcgagctctctcggggacggggggggtgccgcagccatggcctggaccgctactccttcgtgagcctccttagctccactttacagttttcgtcggtcggtcccttcctttcgacccttgacctcagcccactcctcagtcggtccggtcggtcccgtcgggacaggtacggccagacttacctggtaggggaactaccaacagttggaaccgtaaaaacgtcgtgacgtacgtacggtaaccaacacgaacgtccgaggcccgacgggccccctacgttccccgtacgggtacctaacgttaccttaaagttaaacgggacttaaacccgtaaaacccggggtccccttacgttacggggaatacccccgtaggaaacccgtacgtttacctccggtaccggtaccctacccgtaagttaccggaaccgaaccggtacggacccctaacctacgaccacgtacacgacgacgacgtacccgagtcggatagtgacggtctagtacgttacttccgtacgtactaacgtttcggactagtccgtacgcgtcggtacggttacggtcgggacgtacgacgggtaacacgtcgtacggtaaccgtcgttaacgcacggtaaccccgaggtaccgtcccgtacccgtacggttcctaccggttccgttcccgtaccccgtcccgttacccggtcgttaacgggtcgtaccgggttccgttaccgggtacgggaccgggttaccggaccggtacgggacccggtaacggcccggtaacgg

SEQ ID NO: 175201 - DNA, 744 bp, Homo sapiens
  misc_feature: GYAE6OF01BMXLT.47.52.E08.1.454.CMB.1.raw
  modified_base (270)..(270): a, c, t, g, unknown or other
  misc_feature (270)..(270): n is a, c, g, or t
tcagagctcacgtacacgaccggtgctcgatttagtcgagctctcagagagaaagggggcatcacataacaaccacattcctcctctaaagaacgcccctgggagcacagctcatcaccatggactggacctggaggttcctctttgtggtggcagcagctacgaggtgtccagtctcgaggtgcagctggtgcagtcgtgggctggtaggtggaaggacgtccgtgggtcctcgggtagtaacggtctacgtggcgtacgggtcttcgnggacggcctaccgttcggactacctacacgttacgtcggtcgtgggtcgacgacgtacggtccccgtaggacggaagggtccttaggaaggtgggaagttcggggacgtaggtctaacgttccggtacttaccgtacgtaaacctaaaacaaccgtaccgtacaacggtaacgtaaccggttaccgggaactaacgggtttacgtttaaccggttaccggaacgggtaactaaccgtaccgaaggaacgaaacgcgtaccctagtacgtaggaacgtcgtacggacgtacgtaccgttagaggtacttacgacggaaccggaagttacccggactttaacgttaagttcctaaacggtaaactaaacggttcgttaccggtttacggacggtaaacggggtaaccctaaccggtaaggaccccgtacgggaacccttaacggcccgggtacgggggtaaccctaaacccggggg

SEQ ID NO: 175202 - DNA, 566 bp, Homo sapiens
  misc_feature: GYAE6OF02GKTGS.47.52.E08.1.454.CMB.1.raw
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagagctcacgtacacgaccggtgctcgatttagtcgagctctcagagagaaaggggcgatcacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaaggagccgtgggtcctcggtgaaggtctcctgcagggcttctggaggcaccttcggcacctacactatcggctgggtgcgacacgtcccctggacaagggcttgagtggagtgggcggatcattcctattcctagactaaaacaaactcgacacagaagttccggganagagttacgttaccgcgacaactccacganacagccanatagganctagcgacgacctagagtatcaggaccgacgacggtcctaattttactacgtagtaaactaaagacttgttagtaccggaaggggtaaactaccgaaggaccttaggaaccggtacccgacggttacggggcccgtaaccgggg

SEQ ID NO: 175203 - DNA, 862 bp, Homo sapiens
  misc_feature: GYAE6OF02HHHRJ.47.52.E08.1.454.CMB.1.raw
tcagagctcacgtacacgaccggtgctcgatttagtcgagctctctcggcggggggggtgccgcagccatggcctggaccgctctccttctgagcctccttgctcactttacagtttctgtggcctcctttgacctgactcagccactctcagtgtccgtggccctgggacagactgccagtaccttacctggtggggaatcaactagttaggaacgtaaaaatgtgcacgtaggtaaccaacagaacgccgaggccgacggccctgtcctggtcatctataaggataaccaaaccggtccctacgtacgggactcccgtagaacgtacttcctcgtcggtcctacctaacgtttccggaaccaaccgaccggacccaacccgtcgaccaactaccgacgacagaccgacccgtaaggtccggaagacgtaggaggtcctaggtacctttaagttttccgtacggttaaccgttaaagttttacgggtaacctacgttccgtaccgtcgttacggtaccgggttaacggttccgggaccggtaaccggtaaccggggaacccgtaacggtacccgttaacgggttaaccccgttaacccgttaaacggtacccgtaacccggtaaccccggtaaaccggggttcccttaacccccggttaccccccggtttaccgggttaaccccttaaccccggttacccgttttacccccggtttacccccccgttaacccccgttttaccccggtttaaccccggttaacccgggttaaccggtaacccggttcccgtttaacccggttacggggtaaccgggtcccggggggtacccgttaccgggtaccggaacgggttaaccccgg

SEQ ID NO: 175204 - DNA, 696 bp, Homo sapiens
  misc_feature: GYAE6OF02IHJM3.47.52.E08.1.454.CMB.1.raw
  modified_base (368)..(368): a, c, t, g, unknown or other
  misc_feature (368)..(368): n is a, c, g, or t
tcagagctcacgtacacgaccggtgctcgatttagtcgagctctcagagagaaagggggcatcacataacaaccacattcctcctctaaagaagcccctgggagcacagctcatcaccatggactggacctggaggttcctctttgtggtggcagcagctacaggtgtccagtctcaggtgcagctggtgcagtcgtggggctggaggtgaaggagccgtgggtcctcggtgaaggttcctccgtgcgagggtcttcgtgggacgctaccgttcggcctacctacgactagtcggctggggtcgcgacgtacggtccccctagggaccaagggcttaggagtggagtgggcgagtcattcctattccngactaaaaacaactacgacaagaacgtaaacggttccgggaactaaggtacgtttaacccgtttaaccgacgggaaccgtaaacgtcccgaaacggaagaaaccgacggtaccctaacgtaacgtagggaacgaccgttagaaccgagtacccgtgaacggattaccgtacgaacccgaacgtaacccgggtccctaaagttttaactaaccgttagttaaaacgaaacggtattccgtttaggtaccggaaggggtaaaccttaaccgggaaggttacccacgggtaaacccttacccgaacggttccggggacccgaacccggggg

SEQ ID NO: 175205 - DNA, 682 bp, Homo sapiens
  misc_feature: GYAE6OF02IVOQG.47.52.E08.1.454.CMB.1.raw
tcagagctcacgtacacgaccggtgctcgatttagtcgagctctctcggcgggggggtgccgcagccatggcctggaccgctctccttctgagcctccttgctcactttacagtttctgtggcctcctttgacctgactcagccactctcagtgtccgtggccctgggacagacggcagacttacctggtaggggaatcgaacattggaacgtaaaaatgtgcacgtggtaccaacgagaagccaggccaggcccctgtcctggtcatctataaggactaaccaaaccggtcccttcgtaggggacttccccgtagaaaccgtacttcctacgtcggccttaccaaagttccggaactaacgaccggaccccaaccgtcgaaccctagtcgaagccaagacgacccgaaagtcggagagtggaggctagacttagtttctagtacgtaaagtttcgggactacgtcctccggcgttacggtacggttacgttccgggacgaccggaaggggtaacccgaacgtcgtacggacccgttacctaaggtcgacggacccgtaaggtcctaccggacccccgttcgggtacctaccgttccgttaccgttccccgtcccgtaccgttaccgtaacgtcgtacgtcctcggtacggacggtccggacgttaggacgacggccgtacg

SEQ ID NO: 175206 - DNA, 547 bp, Homo sapiens
  misc_feature: GYAE6OF02F74BK.47.52.E08.1.454.CMB.1.raw
  modified_base (501)..(501): a, c, t, g, unknown or other
  misc_feature (501)..(501): n is a, c, g, or t
  modified_base (543)..(543): a, c, t, g, unknown or other
  misc_feature (543)..(543): n is a, c, g, or t
tcagagctcacgtacacgaccggtgctcgatttagtcgagctctcccgcgggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggcctctggggactccctgaacgattcctctggctccaattccggacaacaccggccaccctgaccatccagcagacgacccaaggtccggagactggaggctagacttaatttctgtactaaagtttgggacatctccgctgcggtattcggcgcagggaccaagctcgaccgtctaagtcacgcccaaggctcgcccctcgtccactcctcgtcccnccctcctctacgtgacgtctctgcgcggcgtcggcacggcgntacg

SEQ ID NO: 175207 - DNA, 692 bp, Homo sapiens
  misc_feature: GYAE6OF02HISKJ.47.52.E08.1.454.CMB.1.raw
tcagagctcacgtacacgaccggtgctcgatttagtcgagctctcagagagaaagggggcatcacataacaaccacattcctcctctaaagaagcccctgggagcacagctcatcaccatggactggacctggaggttccttctttgtggtggcagcagctacaggtgtccagtctcgaggtgcagcgtggtgcagtcgtggggctggaggtggaagggacgccgtgggtccgtcgggtaggtaacggtcctccgtgcgaggggtcttcgtggacggcctaccgttcgcctacctacactacgtcggcgtggcgcgacgacgtcccgtaggacgaggtctgaggtggagtgggcgacgtctacttcctattcctacgtaactaaaaacaactacgactaacgaagtaacgtaccggacaggtacgtttaccgtaccggacggtacaacgtacgaacgaagtaacacgtacctaagcgtaggacgctaggacgtaccgacgtggaacgtcgttacgacggaaccgacggtaccggtaccttaagttttaactaaccgttaacgtaaactaaacggttctttacggttaacgggtaaccggaaaggggttaaaccctaaccgggtaaccggtaccgtaacggtaacccggtaaccccgacgggggttaccggggaaccccggttaaaccggggg

SEQ ID NO: 175208 - DNA, 771 bp, Homo sapiens
  misc_feature: GYAE6OF02IRG8T.47.52.E08.1.454.CMB.1.raw
tcagagctcacgtacacgaccggtgctcgatttagtcgagctctctcggcgggggggggtgccgcagccatggcctggaccgctctccttctgagcctccttgctcactttacagtttctgtggcctcctttgacctgactcagccactctcagtgtccgtggccctgggacagacggccagacttacctgtggggaatcaacattggaacgtaaaaatgtgcactggtaaccaacagaacgccgaggccacggcccctgtcctggtcatactataaggtataacgaaccggccctctgggactcccgtagaacgtattctcgtcggcctacctaagttccggaacaaccgaccggccccaacccgtacgaacctacgtccgaacgcaaggaccgaccccgtaaggtaccgggaagtaacggtacggacggacgtacggtaactttacgtttcgtacgtttacgtaaaggtttttacgggactaacttccgttccggtcgttcggtaccggtttacgtttccgggcgtacggtaacgggaaaccgtaagggtccgtaccggtaacccgttaccgtaaacgggtacgaaccggtaacccgaacgggtcccgtacccggtcccccggttacgggttccccgactttcccgttaccggtttacccccctaccccgtttcccttacccggttaaccggtaccggttaccgtaccgttaccggtccgggtaccgggccgggtaccgttaccggggacgtaaccgggccgttaaccg

SEQ ID NO: 175209 - DNA, 633 bp, Homo sapiens
  misc_feature: GYAE6OF02FU0MR.47.52.E08.1.454.CMB.1.raw
tcagagctcacgtacacgaccggtgctcgatttagtcgagctctcagagagaaaggggcatcacataacaaccacattcctcctctaaagaagcccctgggagcacagctcatcaccatggactggacctggaggttcctctttgtggtggcagcagctacaggtgtccagtctcaggtgcagctggtgcagtcgtggggctggaggtgaaggagccgtgggtcctcggtgaaggtctcctgcgagggtcttcgtggaggcctaccgttcggccacctacgacttacgtccggcgtggggtcgccgactacggtccccgtggaaccgaagggtccttggagtggagtgggacggagtctacttcctagttcctagaactaaaacaacgtcgcaacgagtacggttccgggaatacgtacgtttaccgtttaccgacggtaacgtaactccgaacggagaacacgacctacgagtggagcgtaggacgtccgacgtgacgatcgtacgacgaaccgacggaccttaatttactacgtacgtaaccaaagtcttacgtttaggaccggtaaggggtaacctaccggaaggtaaccctaggaaccctaccgaccggtcggggacccgtaaccgggg

SEQ ID NO: 175210 - DNA, 558 bp, Homo sapiens
  misc_feature: GYAE6OF02F6S53.47.52.E08.1.454.CMB.1.raw
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagagctcacgtacacgaccggtgctcgatttagtcgagctctcagagagaaagggggcatcacataacaaccacattcctcctctaaagaagcccctgggagcacagctcatcaccatggactggacctggaggttcctctttgtggtggcagcagctacaggtgtccagtctcaggtgcagctggtgcagtctgggggctgaggtgaaggagcctgggtcctcggtgaaggtctcctgcaggcttctggaggcacttcggcacctacactatcggctgggtgcgacagtcccctggacaagggcttgagtggatgggcgagtcattcctattcctgctaaaacaactacgcacagaagttccggganagagttacgttaccgcgacgaatccacggagaacagcctaanatggagctggacgcgacctagagatctggaccacgacggcctaattttactacttagtaacaaagatacgttacgtacgacggggtaaacttaccggaaggacccttaggaaccgtaccgacggtacggggtaccctaaaccgggg

SEQ ID NO: 175211 - DNA, 683 bp, Homo sapiens
  misc_feature: GYAE6OF02FW18P.47.52.E08.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
tcagagctcacgtacacgaccggtgctcgatttagtcgagctctcagagagaaagggggcatcacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaaggagcctgggtcctcggtgaaggtctcctgcagggcttcgtggaggcaccttcggcacctacactatcggctgggtgcgacacgtcccnggacaagggcttgagtggatgggcgagtcattcctattccngactaaaacaactacgcaacgaagaacgttccgggaatacggagtttaccgtttaccggacggtaacgtaaacgtcccgaacggtaaacgaaccgtaacggtaccccttaaacgacgttacggggaacgtaccgttaggaacggacccgtaaccgttaggaacgtaacgttccgtacgggaaccgaaccggccgggtaacccttaaagtttttacgttaacgtaacggttaaaccaaaaggtcttacgtttacggtaccggaagggggtaaactaacccggtaaggtaacccttagggaaccccggtaacccgacgggttacgggggaccctaaacccggggg

SEQ ID NO: 175212 - DNA, 135 bp, Homo sapiens
  misc_feature: GYAE6OF02HZH6B.47.52.E08.1.454.CMB.1.raw
  modified_base (112)..(135): a, c, t, g, unknown or other
  misc_feature (112)..(135): n is a, c, g, or t
tcagagctcacgtacacgaccggtgctcgatttagtcgagctctctcggcgggctgcctggtcaaggactacttcctacgtgagctctgagcgggctggcaaggcgcatagnnnnnnnnnnnnnnnnnnnnnnnn

SEQ ID NO: 175213 - DNA, 715 bp, Homo sapiens
  misc_feature: GYAE6OF02GIQYB.47.52.E08.1.454.CMB.1.raw
  modified_base (214)..(214): a, c, t, g, unknown or other
  misc_feature (214)..(214): n is a, c, g, or t
tcagagctcacgtacacgaccggtgctcgatttagtcgagctctcagagagaagggggcatcacataacaaccacattcctcctctaaagaagcccctgggagcacagctcatcaccatggactggacctggaggttcctctttgtggtggcagcagctacaggtgtccagtctcaggtgcagcgtggtgcagtcgtggggctgaggtgaaggngccgtgggtcctgggtgacggtctaccgtgccgagggcttcgtggacggtctacccgttcggcctaccgtacacgtacgtcggtcgtggggtcgcgtacgtacgtccccgaggacgacgggtctggagtggaggtgggacggtagtcgtatttccctagttccgtagaaccttaaaacaacgttacgacaacgtaaggtaacggttacccggggagtaacgttaggtttaaccgttacccggacggtaaccgtacgtacccggaacgtaacggaacctaacggacccttaacgtacggtacggttacgacgttaggaccgaccgggtacctagggaacggtacttccggacggaacccggaaccgtaccgggttaacctttacgttttaacgttaaccgtaagttaacgaaacggttccttacggttacggtaacggtaacgggtaaccgttaccgacggtacctacggacccgacgtaccggtacgggacgtaacccggg

SEQ ID NO: 175214 - DNA, 742 bp, Homo sapiens
  misc_feature: GYAE6OF02HBEMS.47.52.E08.1.454.CMB.1.raw
  modified_base (396)..(396): a, c, t, g, unknown or other
  misc_feature (396)..(396): n is a, c, g, or t
  modified_base (516)..(516): a, c, t, g, unknown or other
  misc_feature (516)..(516): n is a, c, g, or t
tcagagctcacgtacacgaccggtgctcgatttagtcgagctctcagagagaaagggggcatcacataacaaccacattcctcctctaaagaagcccctgggagcacagctcatcaccatggactggacctggtacggttccttcgtttggtggtggcagcagctacgaggtcgtccagtctcgagggtgcgaggtcgtgggtacgcgtacggtcggtggggctgggaggtaggaacgggtacgtccggtcggggtccgtacgggtaggtaacggttcctcgtcgcggtacggggtcttacggtgggacgcctaccgttcggacctaccgtacacgtgtcggtcgtggtcgaccgtacgtaccgtccccgtaggacggtacggtctaggaggtggngtgggacgtcgtctacttacgtagttcgtagtaactaaacgactcgacacgtacgtacggtccgaacgtgtacgttaccgtacggacgacgtacgtccgaagacgactcgtacagtacgnggaacgtcgtagaccgtacgtacgtggtaactacgtacgaaccgggtaccgaaaccgtaccggtttaacgtttaacttttaacggtaccttaaagggttaaaaccttacggttaccgtttaacggtacggttaacggggaaaccggtaacgtaacccgggtacgacccgggttaaccgacccgggtacccggttacgggaccccggggtaacggttaaccccgggg

SEQ ID NO: 175215 - DNA, 933 bp, Homo sapiens
  misc_feature: GYAE6OF02IOB93.47.52.E08.1.454.CMB.1.raw
tcagagctcacgtacacgaccggtgctcgatttagtcgagctctcagagagaaagggggcatcacataacaaccacattcctcctctaaagaagcccctgggagcacagctcatcaccatggactggacctggagttcctcgtttgtggtggcagcagctacgaggtgtccagtctcgaggtgcagtcgtggtcgcacggttcgtaggggtctggagggtaggaaacgggtacgtcccggttcggggtacccgttcggggtacggtaacgggttcccttaccgtaggccggtaacgggggtcctttcggtacggggtaccggtccgtaacccggtttccgggacctaaccccttaaccgtaaccgttacggtccgggtaccggttcggggttaccggacccggtaaccgtacccggttacccccggtagggaaccggtaaacggggttcgttaggggtaacggttacggggagggttacgggggaccggttaacggttaccgtaccgtttaccgtttaaccgttcccgttaaacgtaaacccgttaaaaaacccgtaaaccgttaccgaaccgtaacgtaaacggttaaccgggttaccccgggaacgttaacggtttaacgggttttaaccccgggtttaacccggaaccgggtaaacccgtaaaccgttaccccggaaccggtaaacgaaacccggtaaccgtacccgtaacgtaaggttaccgggacggtaccgtacgggaacccgtacccgtacgtaggtaactcggtaccgtacgggtaaccgaaccgtaccgttaaccttaagttttaaccttaacgtaacgttaaaccgaaagttctttacggtaacggtaacggtacgggtaacctaaccggaacgtacccgtacggtaacccgaccggaccggtaccggacccggtaacccggg

SEQ ID NO: 175216 - DNA, 157 bp, Homo sapiens
  misc_feature: GYAE6OF01DXJAN.13.27.C05.1.454.CMB.1.raw
  modified_base (156)..(157): a, c, t, g, unknown or other
  misc_feature (156)..(157): n is a, c, g, or t
tcagtcacgtactacacgaccggtgctcgatttagacgcgatcgaagggtttgggaccacggtcaccgtcctaggtcagcccaaggccaaccccactgtcactctgttcccgccctcctctagtacgtgactgagcgggctggcaaggcgcatagnn

SEQ ID NO: 175217 - DNA, 557 bp, Homo sapiens
  misc_feature: GYAE6OF01ERFY4.13.27.C05.1.454.CMB.1.raw
  modified_base (249)..(249): a, c, t, g, unknown or other
  misc_feature (249)..(249): n is a, c, g, or t
tcagtcacgtactacacgaccggtgctcgatttagacgcgatcgaagggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaaccngcagttatcactggggtggatccggcagcccccggggaagagctggagtggatggggaggatttattatactggcaatacttacgacaatccgtcctcaagagtcgagtcacctgtccgtggacacgccgaataaccagttcctccctagaaagtcgacctctgtgaccgtcgcagacacggccatttattattgtgtgagattacgacttttggaatggtactagtgacttcgatcgacttacgtcgggccctggaactccgtggtccacccgttctccctcacgccctcccgaccgaacggtcccc

SEQ ID NO: 175218 - DNA, 543 bp, Homo sapiens
  misc_feature: GYAE6OF01EJP0I.13.27.C05.1.454.CMB.1.raw
  modified_base (248)..(248): a, c, t, g, unknown or other
  misc_feature (248)..(248): n is a, c, g, or t
  modified_base (350)..(350): a, c, t, g, unknown or other
  misc_feature (350)..(350): n is a, c, g, or t
  modified_base (509)..(509): a, c, t, g, unknown or other
  misc_feature (509)..(509): n is a, c, g, or t
  modified_base (527)..(527): a, c, t, g, unknown or other
  misc_feature (527)..(527): n is a, c, g, or t
tcagtcacgtactacacgaccggtgctcgatttagacgcgatcgaagggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctcattaaaaccngcagttatcactgggggtgatccggcacggcccccggggaaggagcgtggagtggatggggagtatttattatactggcaatacttacgacaatccgtcctnaagagtcgagtcacctgtccgtggacacgccaataaccagttctccctgaaagtgacctctgtcgaccgtcgcagacacggctatttattattgtagtgagtatacgtacttttggaatggactatgtactcgatcgactcgtcgggcctggaactcgnggtcaccgtctcctcacnccctccaccgaggccc

SEQ ID NO: 175219 - DNA, 698 bp, Homo sapiens
  misc_feature: GYAE6OF01AVBOR.13.27.C05.1.454.CMB.1.raw
  modified_base (256)..(256): a, c, t, g, unknown or other
  misc_feature (256)..(256): n is a, c, g, or t
  modified_base (386)..(386): a, c, t, g, unknown or other
  misc_feature (386)..(386): n is a, c, g, or t
  modified_base (646)..(646): a, c, t, g, unknown or other
  misc_feature (646)..(646): n is a, c, g, or t
tcagtcacgtactacacgaccggtgctcgatttagacgcgatcgaagggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtcccctcacttgcactgtctcgagggtgcctaccaattaaaacccngctagttactcgacggtgggggtgacgtccggcaccgggaccccggggaagacgcgtgggaggtggagtgggggagtatttattatacgtacggactaattacttaacgaactacgttcccgttccctanaacgtgtccgtatcctaccgtgtccggtacggaccaccgaccgtaaactaaccctacggtttccctacccgtaaggtaaacgtacgtacccttacgttcggtacggacccgttcgaacacggaaccgtacgtaccctattttattattgtgtagaagtacgtacgttagttttaggaattcggattacgtgtaaccttcgatccggtaagttacccgggtcggggtacccctacgggttacgttcccggtacggttaccncccgttccttccccgtacgtacccacccctcccgaaaccggccggtaccccg

SEQ ID NO: 175220 - DNA, 878 bp, Homo sapiens
  misc_feature: GYAE6OF01BJCD1.13.27.C05.1.454.CMB.1.raw
  modified_base (305)..(305): a, c, t, g, unknown or other
  misc_feature (305)..(305): n is a, c, g, or t
  modified_base (702)..(702): a, c, t, g, unknown or other
  misc_feature (702)..(702): n is a, c, g, or t
tcagtcacgtactacacgaccggtgctcgatttagacgcgatcgaagggtttggggagggaagtgctttctgagagtcatggatctcctgtgacaagaaaatggagcacctgtgttcttcctcctgctggtggcggcctccagagtcggtcctggacccaagtgactaggttgggtggacggtccgggccctaggggctgggtagtaacgtcccgttacgaaccgtaccccgttcgtccccttactacgttcgacctacgttcgtccgtcgtaagggtcgaccttaacctaaaacgttaaaaccngtacgtaagtttaccgtaccggtacggttgggggtacggtaccggtacccgggaaccggtaaccccggggtaacccccgggggtaaaggccggtaccgggttaagggtagggtacggggtaagggtaggggtaaggtttaaacgttttaacgttaacgtacggtaacggtaacttaaacgttaccgtaaccgaacgtaccgttcccgtacctaacgtaacggtacgttaccgtaccgtaccgtaccgtcggtaccgtacggaaccgtaccgtaacccgtaacgtaccgtaccgtttaccgtaacccgtaaggtaaccgttaccgtaccgtacgttaccggtaccgtacccggcaccggtaacgacccgtacgttcttaagtttacgttagtgtaggngtaactacggtacgttaggttacgagtcgtagttactacgtcgtaacgtcgtaccgtaacggttccggtaccgtaccgttacggtaacctccggttaccgaacccgttcccgttcccttacccgtacccgttacccgaaaccccttacccggaaaccccggtaacccgggtccccg

SEQ ID NO: 175221 - DNA, 162 bp, Homo sapiens
  misc_feature: GYAE6OF01BTBYP.13.27.C05.1.454.CMB.1.raw
  modified_base (149)..(149): a, c, t, g, unknown or other
  misc_feature (149)..(149): n is a, c, g, or t
  modified_base (155)..(162): a, c, t, g, unknown or other
  misc_feature (155)..(162): n is a, c, g, or t
tcagtcacgtactacacgaccggtgctcgatttagacgcgatcgaagggtttgggaccacggtcaccgtcctaggtcagcccaaggccaaccccactgtcactctcgttcccgccctcctctagtacgtgactgagcggctggcaggcncatagnnnnnnnn

SEQ ID NO: 175222 - DNA, 567 bp, Homo sapiens
  misc_feature: GYAE6OF02IL4CE.13.27.C05.1.454.CMB.1.raw
  modified_base (490)..(490): a, c, t, g, unknown or other
  misc_feature (490)..(490): n is a, c, g, or t
tcagtcacgtactacacgaccggtgctcgatttagacgcgatcgaagggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtggatccggcagcccccggggaaggagctggagtggatggggaggatttattatactggcaatacttacgacaatccgtccctcaagagtcgagtcaccctgtccgtggacacgccgaaataacccagttcctccctagaaacgtcgaacccttctcgtgaccgtcgcacgacacggccatttattatttgtgtgagatacgtacttttggaatggcttagngtactcgatccgactacgtgggccctggaacttccgtggtccaccgtctccctcacgccctaccaccgaggtacccc

SEQ ID NO: 175223 - DNA, 586 bp, Homo sapiens
  misc_feature: GYAE6OF02G4ZZ6.13.27.C05.1.454.CMB.1.raw
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (396)..(396): a, c, t, g, unknown or other
  misc_feature (396)..(396): n is a, c, g, or t
  modified_base (559)..(559): a, c, t, g, unknown or other
  misc_feature (559)..(559): n is a, c, g, or t
tcagtcacgtactacacgaccggtgctcgatttagacgcgatcgaagggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaaccngcagttancacgtggggtgatccggcacggcccccggggaaggagctggagtggagtggggagtatttagtatacgtggacaatactacgacaatcccgtcctacaagagtcgagtccacctgtccgtggacacgaccgaataaccngttctccgtagaaagtcgacctctcgtcgaccgtcgctagacacggacctatttacttattggtgtcgagtactacgtacgttttaggaattggtacttagtacgacttcggtatacgactacggtcgggtaccctagggtaacttccgtagtccaccgttcncctcacgccctaccgaccgaggtcccc

SEQ ID NO: 175224 - DNA, 804 bp, Homo sapiens
  misc_feature: GYAE6OF02F47V1.13.27.C05.1.454.CMB.1.raw
tcagtcacgtactacacgaccggtgctcgatttagacgcgatcgaagggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctcgtccctcacttgctactgtctcgaggtcggcctaccaacttaaaacccgagtactagtttactcgtacggttgggggtaggtacgtccggacgaccgggaccccccgggggaaggacggtcgtagggaggtgggtacggtagggggaaggttaattttaagttacttacgtacgggactaacgttaaccgttaacgaacctaaccgttcccgtacccctaacgtaaggtaacgttccggtaccgtacccgtaccgttacggttacccggtacggaacccggtacccgaaacccggtaaacgtaaacccgttaacgttcccgttaacccgtaacggtaaagtaccgtacccttaccgttacggtacggtaccccgggttacgacgacgtaacccgaacgggtcccttaaagtttacgtttagtttggtacgtaggtacgtaagttaccgttacgtttagaacgtgtactagttcgtaacgttacgacgttacgaaccgtaggtccgggtacctacgggttaacctccggtcgtacccgtaccgttacccgtccgtaccgaccgttaccccacccgtacccggtacggttaccccg

SEQ ID NO: 175225 - DNA, 178 bp, Homo sapiens
  misc_feature: GYAE6OF01D6AB4.44.8.A08.1.454.CMB.1.raw
  modified_base (178)..(178): a, c, t, g, unknown or other
  misc_feature (178)..(178): n is a, c, g, or t
tcagacagtatatacacgaccggtgctcgatttagcatactctacaaacacaaagggcccatcggtcttcccctggcgccctgctccaggagcacctccgagagcacagcggccctgggctgcctggtcaaggactacttcctatatactgtctgagcgggctggcaaggcgcatagn

SEQ ID NO: 175226 - DNA, 380 bp, Homo sapiens
  misc_feature: GYAE6OF01DDLL5.44.8.A08.1.454.CMB.1.raw
  modified_base (377)..(380): a, c, t, g, unknown or other
  misc_feature (377)..(380): n is a, c, g, or t
tcagacagtatatacacgaccggtgctcgatttagcatactctacagggccggccagactgttgacgacgacttagcctggtaccaacagaagcctggccaggctcccagactcctcatctatggtgcatccaacagggccactggcatcccagccaggttcagtggcagtgggtctgggacagacttcactctcaccatcagcagcctagagccttaagattttgtgatgtattactgtcatttccatggtcccttacctcgaacttttggccaggggaccaaactggaaatcaaacgaactgtggctgcaccatctgtcttcatcttcccgccatctgatatatactgtctgagcgggctggcaaggcgcatagnnnn

SEQ ID NO: 175227 - DNA, 342 bp, Homo sapiens
  misc_feature: GYAE6OF01DIZJQ.44.8.A08.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (326)..(342): a, c, t, g, unknown or other
  misc_feature (326)..(342): n is a, c, g, or t
tcagacagtatatacacgaccggtgctcgatttagcatactctacagggaggaattcccaggaacacactgcatctgcaaatgtacaacctcacaagtgaggacacggctgtctattattgtgcgagagccccctgagacggtccccgcttgactactggggccagggaaccctggtcaccgtctcctcagcctcaccgaagggcccatcggtcttccccnggccgccctgctccaggcncacctccgagagcacagcggccctgggctgcctggtcaaggctacttccncgatcgcgtctggagcgggctggcaaggcncatagnnnnnnnnnnnnnnnnn

SEQ ID NO: 175228 - DNA, 347 bp, Homo sapiens
  misc_feature: GYAE6OF01ATOEV.44.8.A08.1.454.CMB.1.raw
  modified_base (326)..(347): a, c, t, g, unknown or other
  misc_feature (326)..(347): n is a, c, g, or t
tcagacagtatatacacgaccggtgctcgatttagcatactctacaggggacaattccaggaacacactgcatctgcaaatgtacaacctcacaagtgaggacacggctgtctattattgtgcgagaggccccctcggagacggtccccgcttgactactggggccagggaaccctggtcaccgtctccgtcagcctccaccaagggcccatcggtcttcccctggcgccctgctccaggagcacctccgagagcacagcggccctgggctgcctggtcaaggactactccatatactgtctgagcgggctggcaaggcgcatagnnnnnnnnnnnnnnnnnnnnnn

SEQ ID NO: 175229 - DNA, 227 bp, Homo sapiens
  misc_feature: GYAE6OF01BJ60J.44.8.A08.1.454.CMB.1.raw
  modified_base (184)..(227): a, c, t, g, unknown or other
  misc_feature (184)..(227): n is a, c, g, or t
tcagacagtatatacacgaccggtgctcgatttagcatactctacaaacgtacgaaagggcccatcggtcttccccctggcgccctgctccaggagtcacctccgagagtcacagcggccctgggctgcctggtcaaggctacttcctcgatcgcgtctgagcgggctggcaaggcgcatagcnnnnnnnnnnnnnnnnnnnnnnnnnnnnnnnnnnnnnnnnnnnn

SEQ ID NO: 175230 - DNA, 385 bp, Homo sapiens
  misc_feature: GYAE6OF01DU8FZ.44.8.A08.1.454.CMB.1.raw
  modified_base (266)..(266): a, c, t, g, unknown or other
  misc_feature (266)..(266): n is a, c, g, or t
  modified_base (381)..(385): a, c, t, g, unknown or other
  misc_feature (381)..(385): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcagcagcctgcagtctgaagatgttgcaactttattactgtacaaaagtacaacagtcgccccctnactactttccggcctgggaccaaagtgaatatcaaacgactgtgctgcaccatctgtctcatctccgctatctgatatatactgtctgacgtcgggctggacaaggcgacatagnnnnn

SEQ ID NO: 175231 - DNA, 459 bp, Homo sapiens
  misc_feature: GYAE6OF01DOZ3W.44.8.A08.1.454.CMB.1.raw
  modified_base (171)..(171): a, c, t, g, unknown or other
  misc_feature (171)..(171): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (424)..(459): a, c, t, g, unknown or other
  misc_feature (424)..(459): n is a, c, g, or t
tcagacagtatatacacgaccggtgctcgatttagcatactctacgagggccgggccagactcgttgacgacggacttagcctggtaccaacagaagccgtcggccaggctcccagacgtcctccatctatgatacgttctacgtaggggcctctggcatccccagcccgnttcagtcggcagtcgggttcttgggacagtactttcacttcgtcaccatccacccagccttagacgtccctggaagtatttttgacttagttttattactgtctacaccgttaagagtaggaccgtcaatacttcactttcggccctgggaccaagtggatatcgaaacgactgtcggctgcacntctgtctgatccgtcccgcactctgatatatctgtctggacgcggtntagggctaaggcncaagttgnnnnnnnnnnnnnnnnnnnnnnnnnnnnnnnnnnnn

SEQ ID NO: 175232 - DNA, 381 bp, Homo sapiens
  misc_feature: GYAE6OF01DVK9L.44.8.A08.1.454.CMB.1.raw
  modified_base (372)..(381): a, c, t, g, unknown or other
  misc_feature (372)..(381): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagtttattactgtctacaccgtaagagtgcctcaatattcactttcggcctggaccaagtgatatcaaacgactgtgctgcaccatctgtctcatcttcccgcatctgatatatactgtctgagcgggctggcaaggcgcatagnnnnnnnnnn

SEQ ID NO: 175233 - DNA, 332 bp, Homo sapiens
  misc_feature: GYAE6OF01B9Q0O.44.8.A08.1.454.CMB.1.raw
  modified_base (318)..(318): a, c, t, g, unknown or other
  misc_feature (318)..(318): n is a, c, g, or t
  modified_base (324)..(332): a, c, t, g, unknown or other
  misc_feature (324)..(332): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggctacttccacgtctactgctgagcgggctggcaaggcncatagnnnnnnnnn

SEQ ID NO: 175234 - DNA, 333 bp, Homo sapiens
  misc_feature: GYAE6OF01CB9TQ.44.8.A08.1.454.CMB.1.raw
  modified_base (328)..(333): a, c, t, g, unknown or other
  misc_feature (328)..(333): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttcccctggccgccctgctccaggagccacctccgagagccacacgcggcccctgggctgcctggtcaaggactacttcctatatactgtctgagcggctggcaaggcgcatagnnnnnn

SEQ ID NO: 175235 - DNA, 332 bp, Homo sapiens
  misc_feature: GYAE6OF01A88Q7.44.8.A08.1.454.CMB.1.raw
  modified_base (324)..(332): a, c, t, g, unknown or other
  misc_feature (324)..(332): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcttccaccaaggccatcggtcttcccctggcgccctgctccaggagcacctcgtgggggcacgagccggccctgggctgcctggtcaaggctacttcctatatactgtctgagcgggctggcaaggcgcatagnnnnnnnnn

SEQ ID NO: 175236 - DNA, 338 bp, Homo sapiens
  misc_feature: GYAE6OF01AP84B.44.8.A08.1.454.CMB.1.raw
  modified_base (330)..(338): a, c, t, g, unknown or other
  misc_feature (330)..(338): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatccggtcttccccctggccgccctgcctccaggagccacctccgagacgcacagccggccctgggctgcctggtcaaggactacttcctcgatcgcgtctgagcggctggcaaggcgcatagnnnnnnnnn

SEQ ID NO: 175237 - DNA, 334 bp, Homo sapiens
  misc_feature: GYAE6OF01BDRQC.44.8.A08.1.454.CMB.1.raw
  modified_base (322)..(322): a, c, t, g, unknown or other
  misc_feature (322)..(322): n is a, c, g, or t
  modified_base (328)..(334): a, c, t, g, unknown or other
  misc_feature (328)..(334): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcactgtctcctcagcctccaccaagggcccatcggtccttccccctggccgccctgctccaggagccacctccgagagcacagccggccctgggctgcctggtcaaggctacttcctatatactgtctgagcgggctggcaaggcncatagnnnnnnn

SEQ ID NO: 175238 - DNA, 387 bp, Homo sapiens
  misc_feature: GYAE6OF01CVXZQ.44.8.A08.1.454.CMB.1.raw
  modified_base (380)..(387): a, c, t, g, unknown or other
  misc_feature (380)..(387): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgctagtttattactgtcagcagtatagtgactggcctccgttcactttcggcctgggaccacagtcgatttcaaacgaactgtgctgcaccatctgtcttcatcttcccgcctatctgatatatactgtctgagcgggctggcaaggcgcatagnnnnnnnn

SEQ ID NO: 175239 - DNA, 416 bp, Homo sapiens
  misc_feature: GYAE6OF01C1XQG.44.8.A08.1.454.CMB.1.raw
  modified_base (149)..(149): a, c, t, g, unknown or other
  misc_feature (149)..(149): n is a, c, g, or t
  modified_base (400)..(400): a, c, t, g, unknown or other
  misc_feature (400)..(400): n is a, c, g, or t
  modified_base (407)..(416): a, c, t, g, unknown or other
  misc_feature (407)..(416): n is a, c, g, or t
tcagacagtatatacacgaccggtgctcgatttagcatactctacagggacaattccaggaacacactgcatctgcaaatgtacaacctcacaagtgaggacacggctgtctattattgtgcgagacgccccctgagaccggtccccgnttgactacgtggggccagggaaccctggtccaccgtctcctcagccctccaaccgaacgggccccagttccgggtcccttccccccgtgggcccgcccctgcctccgagggacgccacccgtccggaagacgccaacgacggccgggcccctgggggccttcggcccgttgggtacaaacggtaccttaccgttcccgtacggattccggcgttccgtggaacggtccggggctgggaccaaaggggccanaagtagnnnnnnnnnn

SEQ ID NO: 175240 - DNA, 389 bp, Homo sapiens
  misc_feature: GYAE6OF01C9EM5.44.8.A08.1.454.CMB.1.raw
  modified_base (379)..(389): a, c, t, g, unknown or other
  misc_feature (379)..(389): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtaggcctctggcatcccagcccgcttcagtggcagtgggtctgggacagacttcactctcaccatcaccagcctagagcctgaagattttgctagttttattactgtctacaccgtaagaagtggcctccaatattcactttcggcctggaccaaagtgatatcaaacgaactgtggctgcaccatctgtctcatctcccgcatctgatatatactgtctgagcgggctggacaggcgcagtagnnnnnnnnnnn

SEQ ID NO: 175241 - DNA, 330 bp, Homo sapiens
  misc_feature: GYAE6OF01A6T3U.44.8.A08.1.454.CMB.1.raw
  modified_base (324)..(330): a, c, t, g, unknown or other
  misc_feature (324)..(330): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttcccctggcgccctgctccaggacgcacctccgagagcacagcggccctgggctgcctggtcaaggactacttccacgtctactgctgagcgggctggcaggcgcatagnnnnnnn

SEQ ID NO: 175242 - DNA, 408 bp, Homo sapiens
  misc_feature: GYAE6OF01EAG79.44.8.A08.1.454.CMB.1.raw
  modified_base (393)..(393): a, c, t, g, unknown or other
  misc_feature (393)..(393): n is a, c, g, or t
  modified_base (399)..(408): a, c, t, g, unknown or other
  misc_feature (399)..(408): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagtattttgctagtttattactgtctacacgtaagaagtgcctaccaatattcacttcggccctgggaccaaaggtgatatacaaacgactggtgctgccacatctagttcttcacttcttcccgaccatctagattataatactgtctaggacggcgggtctggacaggcctanagtagnnnnnnnnnn

SEQ ID NO: 175243 - DNA, 677 bp, Homo sapiens
  misc_feature: GYAE6OF01DTY0B.44.8.A08.1.454.CMB.1.raw
  modified_base (310)..(310): a, c, t, g, unknown or other
  misc_feature (310)..(310): n is a, c, g, or t
tcagacagtatatacacgaccggtgctcgatttagcatactctacagggggggggtctcaggaggcagcgctctcggggacgtctccaccatggcctgggctctgctattcctcaccctcctcactcagggcacagggtcctgggcccagtctgccctgactcagcctgcccccgtgtctgggtctccgtggacagacgatcaccatctcctgcactggaagcagcagtgacgttggtgtcttataacttgtctcgtggtatacaacaatactacagcagacgacccccaaactcatctatttatgtatntacagtcacgtccggtcctcgtacgggtttctaacgtcgtacttcgtctcggtctaccgtaagtcgtacggacaaccgaccggtccctccctagacctacttctcgtcgggtcctcgacggtctacggaacggacggcggtctacgtaactttacgtacgtcggtacaccgtcgttacaactaaccgtaaactaaccgacgaacgtaccgaacgtaccccttaacccccgtttagtacccgttaccgttaacggggtaaacccggttacggggtaaacccgtaaccggttaccccgtaacccggttacccggttacgggaacccgtacccggtacccccgaaacgggtaccccccctaaacccccgg

SEQ ID NO: 175244 - DNA, 394 bp, Homo sapiens
  misc_feature: GYAE6OF01EW80S.44.8.A08.1.454.CMB.1.raw
  modified_base (385)..(394): a, c, t, g, unknown or other
  misc_feature (385)..(394): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagccccgcttcagtggcagtgggtctgggacagacttcactctcaccatcaccagcctagagcctgaagtattttgctagtttattactgtctacaccgtaagaagtggcctccaatattcactttcggcccttgggaccaaagtggatatcaaacgaactgtgctgcaccatctgtcttcatctcccgcatctgatatatactgtctgagcgggctggacaaggcgcatagnnnnnnnnnn

SEQ ID NO: 175245 - DNA, 429 bp, Homo sapiens
  misc_feature: GYAE6OF01BI2B6.44.8.A08.1.454.CMB.1.raw
  modified_base (275)..(275): a, c, t, g, unknown or other
  misc_feature (275)..(275): n is a, c, g, or t
  modified_base (391)..(391): a, c, t, g, unknown or other
  misc_feature (391)..(391): n is a, c, g, or t
  modified_base (398)..(399): a, c, t, g, unknown or other
  misc_feature (398)..(399): n is a, c, g, or t
  modified_base (401)..(429): a, c, t, g, unknown or other
  misc_feature (401)..(429): n is a, c, g, or t
tcagacagtatatacacgaccggtgctcgatttagcatactctacagggtccgggccagactgttgacgacgacttagcctggtaccaacagaaacctggccaggctcccaggctcctcatctatggtgcatccaacgagggccactggcgtactcccagccaggtttcagtggcagtggtctgggacagacttcacgtctcaccagtcagcagcctagagcctgaagattttgctagtttattactgtctacacgttaagaagtcgcctcaatntcatttcggcctgggaccaaagttggatacgtacaaaacgactgtggctgcaccatctgtcttcatcttcccgctatctagatatagtactgtctgaacgcggtctaggcaaggcncaatagnnannnnnnnnnnnnnnnnnnnnnnnnnnnnn

SEQ ID NO: 175246 - DNA, 387 bp, Homo sapiens
  misc_feature: GYAE6OF01C8AZY.44.8.A08.1.454.CMB.1.raw
  modified_base (149)..(149): a, c, t, g, unknown or other
  misc_feature (149)..(149): n is a, c, g, or t
  modified_base (357)..(357): a, c, t, g, unknown or other
  misc_feature (357)..(357): n is a, c, g, or t
  modified_base (367)..(368): a, c, t, g, unknown or other
  misc_feature (367)..(368): n is a, c, g, or t
  modified_base (370)..(387): a, c, t, g, unknown or other
  misc_feature (370)..(387): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagcccccctgagaccggtccccgnttgactacgtggggccagggaaccctggtcaccgtctcctcagcctccaccgaagggcccatcggtcctcccctggccgccctgctccaggacgcacctccgagacgcacaggccggcccctggggcctcggccgtggtacaaacggaccttaccgttacctatacgttactgttcctggaggccggggtactcgggactaacgggcncgtaataggnngnnnnnnnnnnnnnnnnnn

SEQ ID NO: 175247 - DNA, 535 bp, Homo sapiens
  misc_feature: GYAE6OF01DQIOQ.44.8.A08.1.454.CMB.1.raw
  modified_base (220)..(220): a, c, t, g, unknown or other
  misc_feature (220)..(220): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
  modified_base (507)..(535): a, c, t, g, unknown or other
  misc_feature (507)..(535): n is a, c, g, or t
tcagacagtatatacacgaccggtgctcgatttagcatactctacagggccggccagactgttgacgacgacttagcctggtaccaacagaagcctggccaggctcccaggctcctcatatacgatgcatccagacaagggcccgctcgggccaactccccaaggacctagggtttcaggtgggctaggttggggtctgggaacaggtaccttcacttcncagctatcgagcgacgtggacgctggaggtcttcgtggtacttagttttattcgtgtcctaacgtaccgtaaagagtccgtacctacgtaaattcgttcctaccgtttcggacccgtaggaccgaaaggtttgaacgttaactaaccgaaaacgttacgtggttacggcttaggcctaccgtatcctgtctaccactttcccgtcccgactgtacgtanaactttanacgttagttcggtacgnggtaccggtcgggtacggtacgacgtaacgggctctaaggcgnnnnnnnnnnnnnnnnnnnnnnnnnnnnn

SEQ ID NO: 175248 - DNA, 486 bp, Homo sapiens
  misc_feature: GYAE6OF01CMCOB.44.8.A08.1.454.CMB.1.raw
  modified_base (150)..(150): a, c, t, g, unknown or other
  misc_feature (150)..(150): n is a, c, g, or t
  modified_base (232)..(232): a, c, t, g, unknown or other
  misc_feature (232)..(232): n is a, c, g, or t
  modified_base (439)..(439): a, c, t, g, unknown or other
  misc_feature (439)..(439): n is a, c, g, or t
  modified_base (441)..(486): a, c, t, g, unknown or other
  misc_feature (441)..(486): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagcccccctcgagaccggtccccgnttgactcgtggggccagggaccctggtccaccgtctcctcagccctccaccagggccccagtccggtcctcccccgtggccnccctgcctccgaggcgccacccgtccgaagacgccacgtacggccggacccgttgggggcctcggccgttgggttaccgaaaacgggtaccctttacccgttacccgtaaccggttccttaacctcgggtaccccggttggggacgggtcccggggggtaccgttaccggggaaccgtaaacgggggccggaacctaagtaaccggncnnnnnnnnnnnnnnnnnnnnnnnnnnnnnnnnnnnnnnnnnnnnnn

SEQ ID NO: 175249 - DNA, 392 bp, Homo sapiens
  misc_feature: GYAE6OF01A77TQ.44.8.A08.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (226)..(227): a, c, t, g, unknown or other
  misc_feature (226)..(227): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (347)..(392): a, c, t, g, unknown or other
  misc_feature (347)..(392): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagcccccctgagacggtccccgcttgactactggggccagggaaccctggtcaccgtctcctcagcctccaccaagggcccatcgtctcccccngccnccnnccncagcnccacctcgagncacgngccgccgtggctcgccgtggacgaacggtactacctcctacgtctagtcgcgtggacggccgggtacgtcgggacgaacggccgactagtagctgnnnnnnnnnnnnnnnnnnnnnnnnnnnnnnnnnnnnnnnnnnnnnn

SEQ ID NO: 175250 - DNA, 477 bp, Homo sapiens
  misc_feature: GYAE6OF01CAL6F.44.8.A08.1.454.CMB.1.raw
  modified_base (271)..(271): a, c, t, g, unknown or other
  misc_feature (271)..(271): n is a, c, g, or t
  modified_base (330)..(330): a, c, t, g, unknown or other
  misc_feature (330)..(330): n is a, c, g, or t
  modified_base (434)..(434): a, c, t, g, unknown or other
  misc_feature (434)..(434): n is a, c, g, or t
  modified_base (440)..(477): a, c, t, g, unknown or other
  misc_feature (440)..(477): n is a, c, g, or t
tcagacagtatatacacgaccggtgctcgatttagcatactctacagggccggccagactgttgacgacgacttagcctggtaccaacagaagcctggcccaggctcccagactcctcatctatgatacttctagtagggcctctggcatcccagcccgcttcagtggcagtgggtctgggacagcttcactctcaccatccaccagcctagacgcctagaagtattttgctagtttattactgtctacacgtaagaagtggcctccaatnttcactttccggcctgggacctaaagtggatatacaaaacgactgtggactgacaccgntctcgttcttcacttccgttcccgccattctagtattagtattaccttgtcccgtggtaacggtcccggggcttacgggacgaacgggtccgtcgaacgtaggncatagnnnnnnnnnnnnnnnnnnnnnnnnnnnnnnnnnnnnnn

SEQ ID NO: 175251 - DNA, 521 bp, Homo sapiens
  misc_feature: GYAE6OF01BPSYP.44.8.A08.1.454.CMB.1.raw
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (494)..(521): a, c, t, g, unknown or other
  misc_feature (494)..(521): n is a, c, g, or t
tcagacagtatatacacgaccggtgctcgatttagcatactctacagggccggccagactgttgacgacgacttagcctggtaccaacagaagcctggccaggcctcccagactcctcatctatgatgcatccaagtacgggccgcgggcactcccagccaggttcaggtggcgaggtgggtctagagacagacttcacttcctacaccatcgagccgtacctagacggaccggaagttactttgacttagttttactacgtcgtacaaccgtaccgtagccgaccgtggacccttaaggttacttaggttttcggccgtacggggacctaagcgtagggacgcctaacgaaacgtacgtggttcggattcgaccactattcctgttactcctacgtttccctcccgtacctatctacgtatacttactacgtcgtactaggacgggtccgtagcgggtacgacggtcgacctaagtcgcagcacngntcgnannnnnnnnnnnnnnnnnnnnnnnnnnnn

SEQ ID NO: 175252 - DNA, 539 bp, Homo sapiens
  misc_feature: GYAE6OF01CW2F5.44.8.A08.1.454.CMB.1.raw
  modified_base (510)..(510): a, c, t, g, unknown or other
  misc_feature (510)..(510): n is a, c, g, or t
  modified_base (512)..(539): a, c, t, g, unknown or other
  misc_feature (512)..(539): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagtacttcactctcaccatcaccagtccctaagacgccctagtaagtattttgcctaaacttacgtacctgtcaacagtagtttatactcgtcccccgtttctaccgttttttagggccgggggtaacccaagtaccgttgggaagtaactaccgaaaaccgtaaacgttgtcgggtaccttgacccgaacctattccgtttcggttacctttccgtaacgttcccgtttaccccgccctatttcccgttaggaactttaacttaacgtacttaacgtcgtttagggacgggtggtccggtaggccgtaaggggcctaaccgaagtgncnnnnnnnnnnnnnnnnnnnnnnnnnnnn

SEQ ID NO: 175253 - DNA, 386 bp, Homo sapiens
  misc_feature: GYAE6OF02GOTJ3.44.8.A08.1.454.CMB.1.raw
  modified_base (383)..(386): a, c, t, g, unknown or other
  misc_feature (383)..(386): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagtttattactgtctacaccgtaagaagtggcctccaatattcactttcggccctgggaccaaagtggatatcaaacgaactgtggctgcaccatctgtcttcatcttcccgccatctgatatatactgtctgagcgggctggcaaggcgcatagnnnn

SEQ ID NO: 175254 - DNA, 382 bp, Homo sapiens
  misc_feature: GYAE6OF02HBFHO.44.8.A08.1.454.CMB.1.raw
  modified_base (377)..(382): a, c, t, g, unknown or other
  misc_feature (377)..(382): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagtttattactgtcaacaccgtagcgactggcctaggtacagtttgtccaggggaccaagctggagctcaaacgaactgtggctgcaccatctgtcttcatcttcccgcatctgatatatactgtctgagcggctggcaaggcgcatagnnnnnn

SEQ ID NO: 175255 - DNA, 406 bp, Homo sapiens
  misc_feature: GYAE6OF02JML8J.44.8.A08.1.454.CMB.1.raw
  modified_base (380)..(380): a, c, t, g, unknown or other
  misc_feature (380)..(380): n is a, c, g, or t
  modified_base (401)..(406): a, c, t, g, unknown or other
  misc_feature (401)..(406): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagttttattactgtctacaccgtaagaagtggcctccaatattcattttggccccttggggcccaaaagtcggaatagtcaaaacgaactagtaggctggcaccatcctagtctttcatcttcccgcctatcctgactatataactgtctgancgggctggcaaggcgcatagnnnnnn

SEQ ID NO: 175256 - DNA, 325 bp, Homo sapiens
  misc_feature: GYAE6OF02GN9H1.44.8.A08.1.454.CMB.1.raw
  modified_base (323)..(325): a, c, t, g, unknown or other
  misc_feature (323)..(325): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctgagacggtcccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagnnn

SEQ ID NO: 175257 - DNA, 328 bp, Homo sapiens
  misc_feature: GYAE6OF02JRV9R.44.8.A08.1.454.CMB.1.raw
  modified_base (320)..(328): a, c, t, g, unknown or other
  misc_feature (320)..(328): n is a, c, g, or t
tcagacagtatatacacgaccggtgctcgatttagcatactctacagggacaattccaggaacacacttcatctgcaaatgtacaacctcacaagtgaggacacggctgtctattattgtgcgagagcccctcgagacggtcccgcttgactactggggccagggaaccctggtcaccgtctcctcagcctccaccaagggcccatcggtcttcccctggcgccctgctccaggagcacctccgagagcacagcggccctgggctgcctggtcaaggactacttccacgtctactgctgagcggctggcaagcgcatagnnnnnnnnn

SEQ ID NO: 175258 - DNA, 391 bp, Homo sapiens
  misc_feature: GYAE6OF02JEW7U.44.8.A08.1.454.CMB.1.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (373)..(391): a, c, t, g, unknown or other
  misc_feature (373)..(391): n is a, c, g, or t
tcagacagtatatacacgaccggtgctcgatttagcatactctacagggccggccagactgttgacgacgacttagcctggtaccaacagaagcctggccaggctcccagactcctcatctatgatactttctagtagggcctcttggcatcccagtcccgcttcagtggcagtgggtctgggacagacttcactcgtcaccatcaccagcctagagcctgaagattttgcagtttatactgtcagcagtataatgactggcctcccttggccaagggacacgactgganattaaacgactgtggctgcaccatctgtcttcatctccgcatctgatatatactgtctgagtcgggctgggcaaggcncatgnnnnnnnnnnnnnnnnnnn

SEQ ID NO: 175259 - DNA, 186 bp, Homo sapiens
  misc_feature: GYAE6OF02IK6O1.44.8.A08.1.454.CMB.1.raw
  modified_base (179)..(186): a, c, t, g, unknown or other
  misc_feature (179)..(186): n is a, c, g, or t
tcagacagtatatacacgaccggtgctcgatttagcatactctacaaacacaaagggcccatcggtcttccccctggcgccctgctccaggagcacctccgagagcacagcggccctgggctgcctggtcaaggactacttcctatatactgtctgagcgggctggcaaggcgcatagnnnnnnnn

SEQ ID NO: 175260 - DNA, 330 bp, Homo sapiens
  misc_feature: GYAE6OF02GLWH1.44.8.A08.1.454.CMB.1.raw
  modified_base (323)..(330): a, c, t, g, unknown or other
  misc_feature (323)..(330): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctctggggcacagcggcctgggctgcctggtcaaggactacttcctcgatcgcgtctgagcgggctggcaaggcgcatagnnnnnnnn

SEQ ID NO: 175261 - DNA, 386 bp, Homo sapiens
  misc_feature: GYAE6OF02H4AXI.44.8.A08.1.454.CMB.1.raw
  modified_base (382)..(386): a, c, t, g, unknown or other
  misc_feature (382)..(386): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtaggcctctggcatcccagcccgcttcagtggcagtgggtctgggacagacttcactctcaccatcaccagcctagagcctgaagattttgtagtttattactgtctacacgtaagaagtggcctccaatattcactttcggccctgggaccaaagtggatatcaaacgaactgtggctgccaccatctgtcttcatcttcccgccatctgatatatactgtctgagcgggctggcaaggcgcatagnnnnn

SEQ ID NO: 175262 - DNA, 330 bp, Homo sapiens
  misc_feature: GYAE6OF02FVC8A.44.8.A08.1.454.CMB.1.raw
  modified_base (324)..(330): a, c, t, g, unknown or other
  misc_feature (324)..(330): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnnnnn

SEQ ID NO: 175263 - DNA, 335 bp, Homo sapiens
  misc_feature: GYAE6OF02GAO3P.44.8.A08.1.454.CMB.1.raw
  modified_base (325)..(335): a, c, t, g, unknown or other
  misc_feature (325)..(335): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttcccctggcgccctgctccaggacgcacctccgagagccacagcggccctgggcctgcctggtcaaggctactctatactactgtctggagcgggctggcaaggcgcatgnnnnnnnnnnn

SEQ ID NO: 175264 - DNA, 411 bp, Homo sapiens
  misc_feature: GYAE6OF02J0E29.44.8.A08.1.454.CMB.1.raw
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
  modified_base (397)..(411): a, c, t, g, unknown or other
  misc_feature (397)..(411): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagancctgaagnttttgcagtttatactgtcagctagccgttcctccaggcccgtctccacttttcgggccgggggtaccaagggtcggagagtcgagacgaactggtaggctgccacatctgtcttcatctcccgcatctgntactatactgtctgagcgggtctgggactagggctcgatacgnannnnnnnnnnnnnnn

SEQ ID NO: 175265 - DNA, 390 bp, Homo sapiens
  misc_feature: GYAE6OF02HIJJ7.44.8.A08.1.454.CMB.1.raw
  modified_base (383)..(390): a, c, t, g, unknown or other
  misc_feature (383)..(390): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagtttattactgtctacaccgtaagaagtggcctccaatattcactttcggacctgggaccaaagtggatatcaaacgaactgtggctgcaccatctgtcttcatcttcccgccatctgatatatactgtctgagcgggctggcaaggcgcatagnnnnnnnn

SEQ ID NO: 175266 - DNA, 213 bp, Homo sapiens
  misc_feature: GYAE6OF02HZZIW.44.8.A08.1.454.CMB.1.raw
  modified_base (183)..(213): a, c, t, g, unknown or other
  misc_feature (183)..(213): n is a, c, g, or t
tcagacagtatatacacgaccggtgctcgatttagcatactctacaaacgacaaagggcccatcggtcttccccctggcgccctgctccaggagcacctccgagagcacagcggccctggctgccctggtcaaggactacgttccacgtctactggcctgagcgggctggcaaggcgcatagnnnnnnnnnnnnnnnnnnnnnnnnnnnnnnn

SEQ ID NO: 175267 - DNA, 391 bp, Homo sapiens
  misc_feature: GYAE6OF02FTBF6.44.8.A08.1.454.CMB.1.raw
  modified_base (375)..(375): a, c, t, g, unknown or other
  misc_feature (375)..(375): n is a, c, g, or t
  modified_base (381)..(391): a, c, t, g, unknown or other
  misc_feature (381)..(391): n is a, c, g, or t
tcagacagtatatacacgaccggtgctcgatttagcatactctacagggccgggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagtttattactgtctacaccgtaagaagtggcctccaatattcactttcggccctgggaccaaagtggatatcaaacgactgtggctgcaccatctgtcttcatcttcccgcatctgatatatactgtctgagcggctggcaaggcncatagnnnnnnnnnnn

SEQ ID NO: 175268 - DNA, 332 bp, Homo sapiens
  misc_feature: GYAE6OF02HYSU9.44.8.A08.1.454.CMB.1.raw
  modified_base (238)..(238): a, c, t, g, unknown or other
  misc_feature (238)..(238): n is a, c, g, or t
  modified_base (324)..(332): a, c, t, g, unknown or other
  misc_feature (324)..(332): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggngcacctccgagagcacagaggccctgggctgcctggtcaaggactactcctatatactgtctgagcgggctggcaaggcgcatagnnnnnnnnn

SEQ ID NO: 175269 - DNA, 433 bp, Homo sapiens
  misc_feature: GYAE6OF02HLZ5Q.44.8.A08.1.454.CMB.1.raw
  modified_base (385)..(386): a, c, t, g, unknown or other
  misc_feature (385)..(386): n is a, c, g, or t
  modified_base (390)..(390): a, c, t, g, unknown or other
  misc_feature (390)..(390): n is a, c, g, or t
  modified_base (395)..(433): a, c, t, g, unknown or other
  misc_feature (395)..(433): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccgtcagcaatgtacagcctgaagattttgcagttttattactgtcagcagcgttcctccaggccgctcactttcggcgggggaccaggtgagatcagacaactgtggctgcaccatctgtcttcacttctcccgcatctgatatatactgtctgacgcgggtctcgggacgtacggcgctaagtacgnngtangtacnnnnnnnnnnnnnnnnnnnnnnnnnnnnnnnnnnnnnnn

SEQ ID NO: 175270 - DNA, 388 bp, Homo sapiens
  misc_feature: GYAE6OF02HHKSH.44.8.A08.1.454.CMB.1.raw
  modified_base (370)..(370): a, c, t, g, unknown or other
  misc_feature (370)..(370): n is a, c, g, or t
  modified_base (375)..(388): a, c, t, g, unknown or other
  misc_feature (375)..(388): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagccccgcttcagtggcagtgggtctgggacagacttcactctcaccatcaccagcctagagcctgaagtattttgctagtttattactgtctacaccgtaagagtgcctccaatattcactttcggcctgggaccaagtgatatacaaacgactgtggctgcacatctgtctcatctccgcatctgatatatactgtctgagcggctggcaaggcanatagnnnnnnnnnnnnnn

SEQ ID NO: 175271 - DNA, 414 bp, Homo sapiens
  misc_feature: GYAE6OF02H9F36.44.8.A08.1.454.CMB.1.raw
  modified_base (396)..(396): a, c, t, g, unknown or other
  misc_feature (396)..(396): n is a, c, g, or t
  modified_base (402)..(414): a, c, t, g, unknown or other
  misc_feature (402)..(414): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagacgcctgaagtattttgctagtttattactgtctacaccgtaagaagtggcctcaatattctactttcggcctggaccaaagtggatatacaaacgaactgtggctgcaccattctgtcttactattccttcccgctatctagatatactactgtcgtagacggcgggtctggcggaaggccganagtagnnnnnnnnnnnnn

SEQ ID NO: 175272 - DNA, 439 bp, Homo sapiens
  misc_feature: GYAE6OF02GT50H.44.8.A08.1.454.CMB.1.raw
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (398)..(404): a, c, t, g, unknown or other
  misc_feature (398)..(404): n is a, c, g, or t
  modified_base (406)..(439): a, c, t, g, unknown or other
  misc_feature (406)..(439): n is a, c, g, or t
tcagacagtatatacacgaccggtgctcgatttagcatactctacagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagacgcctgaagtattttgctagtttattactgtctacacgtagagtgcctcaatnttcactttcgcctggaccaagtcgatancaaagactgngctgcacntctgtcttcattccctccgactatctagaattactatactntaccgtgacggtcgggcttcgggacgaacggccgactaatcggatnnnnnnngnnnnnnnnnnnnnnnnnnnnnnnnnnnnnnnnnn

SEQ ID NO: 175273 - DNA, 613 bp, Homo sapiens
  misc_feature: GYAE6OF02HLNWJ.44.8.A08.1.454.CMB.1.raw
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (320)..(320): a, c, t, g, unknown or other
  misc_feature (320)..(320): n is a, c, g, or t
  modified_base (439)..(439): a, c, t, g, unknown or other
  misc_feature (439)..(439): n is a, c, g, or t
  modified_base (483)..(483): a, c, t, g, unknown or other
  misc_feature (483)..(483): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(592): a, c, t, g, unknown or other
  misc_feature (590)..(592): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
  modified_base (610)..(610): a, c, t, g, unknown or other
  misc_feature (610)..(610): n is a, c, g, or t
tcagacagtatatacacgaccggtgctcgatttagcatactctacagggaccgggccgacgacgtgttgacgacgacttaggcctggtaccaacagaagccctggccacggctcccaggcctcctcactctactgactgcatccaacagggtcactggcaacccngtcaggtcagtcgccnggtggtcctgggacacggaccttnaccgtcgtcgaccgtcacncctaagtcgtacacgccgtgaagtattttcncgtaattaattactggtcagactggtacctactacgaacggcctcgacctacgtttaccccgggnggggggttacccgtaaggtacggagtaagtaccggaagtaaccggtaactttgggcgccgttaggcctaaaccgaaggttccttccgtaacggttcaacgtttccctacccccgggttnaccggctttacccggagttaccctttaaagacctcgggttttcncggggttaaaggcccgggtacttaacgggcgaaagtcccgtaaggtaccaggccagtgaattgatgctagctatcaagnngntgtnatccatgatgagngngngngnnngnacgngngcgcngcgcngcg

SEQ ID NO: 175274 - DNA, 429 bp, Homo sapiens
  misc_feature: GYAE6OF02HR0OR.44.8.A08.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (372)..(377): a, c, t, g, unknown or other
  misc_feature (372)..(377): n is a, c, g, or t
  modified_base (379)..(429): a, c, t, g, unknown or other
  misc_feature (379)..(429): n is a, c, g, or t
tcagacagtatatacacgaccggtgctcgatttagcatactctacagggacaattccaggaacacactgcatctgcaaatgtacaacctcacaagtgaggacacggctgtctattattgtgcgagagcccccctcgagacggttccccgcttgactacgtgggggccagggaaccctggtccaccgtctcctcacgcctccaccaacgggcccagtcggtccttcccccgtggccgcccngcctccgaggcncacctcgagancacgacgccggccctgggctcgccgtggtaccaacggtactacttacctataactacgttgtcgtggacggtcgggtcctaggggaccaaggggcctctaacgtagctnnnnnncnnnnnnnnnnnnnnnnnnnnnnnnnnnnnnnnnnnnnnnnnnnnnnnnnnn

SEQ ID NO: 175275 - DNA, 753 bp, Homo sapiens
  misc_feature: GYAE6OF02IVUL8.44.8.A08.1.454.CMB.1.raw
tcagacagtatatacacgaccggtgctcgatttagcatactctacaggggggggggtctcaggaggcagcgctctcaggacgtcaccaccatggcctgggctctgctcctcctccaccctcctcactcgagggcacgagggtcctcgggcccagtctcgccctgactcgacgtccctcccgtccgtcggtccgggtcctcgttcggactacggtcacgtccacctacttcctccgtgcctacgtccggaccaccagccgtagtcgaactagttgggttagttaacttaacgttcgtaccttccgtacggtaaccaacctacccaccgtaacgtaaccaaaccgtaccccctaattacctacttactactttagtactagttacgtacgtaacgtacggcccgtacccgtacgggtaccgggtaccgtacgtacgtccgtcttaccgtcgtaccggtaccttaccgtacggttcgacggtaaccgaccgtacccgtccctacccggtaccggtaccgttcgtccggttacggacccgttaccggacgttcggtaaggtacggtacgtgggtaacggtctacgtaccttagttccgcgttcgttacctcgtaatccggtacggacgtacggtaccgtaacgtttggtttacgcgttaccgtaacggtacgtaacggaccttacggtacctccgtacgtaccgacgaccgaacccgacgtacccaccgtactcgtaccctaccggttccttacccg

SEQ ID NO: 175276 - DNA, 831 bp, Homo sapiens
  misc_feature: GYAE6OF02JR9O3.44.8.A08.1.454.CMB.1.raw
  modified_base (734)..(734): a, c, t, g, unknown or other
  misc_feature (734)..(734): n is a, c, g, or t
  modified_base (749)..(749): a, c, t, g, unknown or other
  misc_feature (749)..(749): n is a, c, g, or t
  modified_base (756)..(756): a, c, t, g, unknown or other
  misc_feature (756)..(756): n is a, c, g, or t
  modified_base (762)..(762): a, c, t, g, unknown or other
  misc_feature (762)..(762): n is a, c, g, or t
  modified_base (766)..(766): a, c, t, g, unknown or other
  misc_feature (766)..(766): n is a, c, g, or t
  modified_base (771)..(771): a, c, t, g, unknown or other
  misc_feature (771)..(771): n is a, c, g, or t
  modified_base (795)..(795): a, c, t, g, unknown or other
  misc_feature (795)..(795): n is a, c, g, or t
  modified_base (799)..(799): a, c, t, g, unknown or other
  misc_feature (799)..(799): n is a, c, g, or t
  modified_base (819)..(819): a, c, t, g, unknown or other
  misc_feature (819)..(819): n is a, c, g, or t
  modified_base (821)..(823): a, c, t, g, unknown or other
  misc_feature (821)..(823): n is a, c, g, or t
tcagacagtatatacacgaccggtgctcgatttagcatactctacagggagagagccaccctctcctgtaggccagtcggagtgttgctaagtaccgacagaacctggccaggctcccgaggctcctcatctatgatgacactaccgaagacggtcacgtcggaccacccgagacgtaggttacgaggtcggacacggtgggtcgtaggacagtaccgttcgacgtacctccgtaccgtacacggtacaagttcgtaaccgtacgacccgttaaggtaacgttacgttttcgacgttttaacgttttaacgttaccgtttggtaccgtaacgtacgttaaccggttccgttttaccccgtacggaaccgggtaccccgttaccgttacccggttaccgggtttttacccggggggaaccgggggggtttaaccccgtaaaggggttacggtaaaccgggtaaccgtttaaccgggtaaacggaaccccgggttaaaaggtttccgggggcggttacccggttaacccggccctttaaaacccggtaaccggtttcggttaccgttttaaccccgttaaacccggttactttcccccggtttaaccccggcctttaacgggtttacctaagtaacgtttaaaccggttaacgtttccgttacggtttacggttcggggaaaccggttcccgggtaactcggggtaaaccccgtacgggtacctacggttaaacgngtcctaggtcgtatngttacgngtatgncgtntacgnacgtactactcgtgtcgtcgctgngcgngagtagtagtacgtacgtcngnnncgtagtcg

SEQ ID NO: 175277 - DNA, 525 bp, Homo sapiens
  misc_feature: GYAE6OF01EJJ4H.51.26.C04.1.454.CMB.1.raw
  modified_base (513)..(513): a, c, t, g, unknown or other
  misc_feature (513)..(513): n is a, c, g, or t
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccctaggacagacagccaccatcacctgctctggagataatttggggtctaagtatgtttcgtggtatcaacatcacccaggccgtccccgatactgctcctctatcatgatgccaagcggccctcagggatccctgagcgattctctggctccaactctggggacacagccactctgaccatccgcgggacccaggctgtggatgaggctggactattactgtcaggcgtgggacgaggggaggcgtgcggtagttttcgggcggagggaccagtctggaccgtccgtaggtcgcgcccgaaggcctcggcccccctcggtccnccgtcgttcccg

SEQ ID NO: 175278 - DNA, 549 bp, Homo sapiens
  misc_feature: GYAE6OF01DOJH6.51.26.C04.1.454.CMB.1.raw
  modified_base (224)..(224): a, c, t, g, unknown or other
  misc_feature (224)..(224): n is a, c, g, or t
  modified_base (484)..(484): a, c, t, g, unknown or other
  misc_feature (484)..(484): n is a, c, g, or t
  modified_base (537)..(537): a, c, t, g, unknown or other
  misc_feature (537)..(537): n is a, c, g, or t
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtacgtgtccctaggacagacagccaccatcacctgctctgganataagtttggggtctaagtatgttcgtggtatcaacatcacccaggccgtccccgatactgctcctctatcatgatgccaagccggccctcgagggactcccgtgacgcgattctcgtggcctccaactcgtgggacacacgccactctcgaccacgtcccggccgggacccgaggctggtggatggaggctgacttattactgtcgaggcggtgggacgaggggacggcgtggcgtagttttcgggcgggagggaccgngtcgtcgaccgtccgtaggtcacgacccgaggccgtccgcccccgtcggtccncgtccgttcccg

SEQ ID NO: 175279 - DNA, 640 bp, Homo sapiens
  misc_feature: GYAE6OF01BKCKR.51.26.C04.1.454.CMB.1.raw
  modified_base (226)..(226): a, c, t, g, unknown or other
  misc_feature (226)..(226): n is a, c, g, or t
  modified_base (430)..(430): a, c, t, g, unknown or other
  misc_feature (430)..(430): n is a, c, g, or t
  modified_base (475)..(475): a, c, t, g, unknown or other
  misc_feature (475)..(475): n is a, c, g, or t
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagcccaccctcagtgtacgtcgtccctaggacagacagccaccatcacctgctctgganattaagtttggggtcttaagtatgtttcgtggtatcaacatccacccgaggcccggtccccgatactgcctcctctatcatgatcgaccaacggccggacccctgacgggtactcccgtggacgcgtacttcgtcgtggacctaccaacgtcgtaggggaccacgacgccctactctacgacctacgtcccggaccgggacccnggtcgtggtggtacgtgggacgctacgtacttagttctcgtacgngggcggtacgggacggaggggcggcgtggtcggttacggtttcggggacgggtacgggtaccgtacggttcgtaccggtacccggttacggtccgggtacgaccggacccggaacggtcccgtacccggtcccccgttacgggttccctccgttccgttaccccg

SEQ ID NO: 175280 - DNA, 633 bp, Homo sapiens
  misc_feature: GYAE6OF01C35UU.51.26.C04.1.454.CMB.1.raw
  modified_base (231)..(231): a, c, t, g, unknown or other
  misc_feature (231)..(231): n is a, c, g, or t
tcagcgatcgtatacacgaccggtgctcgatttagtctagcgactttgggtttggggctgcccagcctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcacctgctctgganatagttgggctaagtatgtttcgtggtatcaacatcaccaggccgtcccgatactcgctcctctatcatgatcgccaagccggccctacgagggactccgtagacgcgtacttcgtcgtcggcctaccacgttcgtacggggactacgacgccctactcgacgaaccgtacgtacccgggccggacccgaggtcgttcggtagggtagtacggacggtcgtagtacttacgttacgtggtacgacgggtcgggtacggggacgacggggtacgtcgttcgggacggttacggtttccgggacggggtacggtaccgtacggttaccgtacgggttacccggtccgtaacggtaccgtaccggaccccggtaaggtaccccgtcccggtcccccgttaccggg

SEQ ID NO: 175281 - DNA, 660 bp, Homo sapiens
  misc_feature: GYAE6OF01CTS6K.51.26.C04.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagcccacctcagtgtacgtcgtccctaggacagacacgccacatccacctgctctgganattaagtttgggtactaagtnttgttcgtggtatcaacntccaacccgaggcccggtccccgatacncgcctcctctatcatgatcgccaaggccgtccctcgaagggctcccgtgacgcgtacttcctcgtcggcctacctacgtcggtacgggacacgtacgccctacttccgacgaccgtaccgtcccggacccgggaacccgtcggtccgtggtacggagtcgggacggtcgtacggtaccttaacgttacgtcggtacggacgggtcgggtaggggaacggaggggacggtcgtcggtacgttacggtttcgggacgggtacggtaccgtacgtccgtcggtacccggtccgtacggccggaaccgtacccggaacggtcccgtcccggtacccccggttccgtacccgtcccgttcccgttcccccgg

SEQ ID NO: 175282 - DNA, 876 bp, Homo sapiens
  misc_feature: GYAE6OF01C69SP.51.26.C04.1.454.CMB.1.raw
  modified_base (197)..(197): a, c, t, g, unknown or other
  misc_feature (197)..(197): n is a, c, g, or t
tcagcgatcgtatacacgaccggtgctcgatttagtctagcgactttgggtttggggctgcccagcctgggcctcaggaagcagcatcgggaggtgcctcagccatggcatggactccctctcttcctcgggcgtccttgcttactgcacgaggactcccgtggccgacctatcgacctgactcacgcccacccgtnacgtcgtccgtccgtccccgaaggaccaggaccacgtacccacctactccaccgtcgcgttcggtacgggaagttaagttaacggttttcggggtaacttaaacggtttgtttgggttttcggtaaggttaactaaccgtaaacgtacctaccccgaaccccggtacggggccccccggttaacccctaagttaccccgttcggtaccctttcccttaacgttaactacgtacgttacggaacgtccggaaacccgtaaccggggtcccggtcccctaaccgggaaacggttccctacccggttacggaaccggttcttaaccgtttcccgtcggttccccggaacctttacccgtaaccgggtttacggaccggggaaacctccgaccgtacctaccggtacgttacccggacccgtaccggtacccggggaacccgggtaccgtgggtccgttaagggtcgggaaccggttggaccgttcttaacgttacgttaccgtacggtcggtacgggtaaccgggtgggtaacgggtacggaacgggttctacggttcggttacggtttccgggttacgggaccgggtaccgtaccgttcgggtccctaacccgggtccgggtacgtccggaaccggcccggttaaacccggacggttccccctcccgggcccccgtttacg

SEQ ID NO: 175283 - DNA, 808 bp, Homo sapiens
  misc_feature: GYAE6OF01CQB58.51.26.C04.1.454.CMB.1.raw
  modified_base (192)..(192): a, c, t, g, unknown or other
  misc_feature (192)..(192): n is a, c, g, or t
  modified_base (378)..(378): a, c, t, g, unknown or other
  misc_feature (378)..(378): n is a, c, g, or t
tcagcgatcgtatacacgaccggtgctcgatttagtctagcgactttgggtttgggctcgcccagcctgggcctcaggaagcagcatcggagtgcctcagccatggcatggactccctctcttctcggctccttgcttactgcacaggactcccgtggcccgacctatcgacctgactcaccgcctaccctnacggtccgtccgtcgtaccccgaggacacgacgacgacccactattccacctgacgtacgtaggtacgtaagtttacggttttacggggtacttaaggttgttcggtttacggtgttaacgacctaaactcgtacccaccggtacgggtcccccgtacctattaccgccgtacctcctttactaanccgtaagtcgactccggtaacgacggtcccggacctacggaccggtaccttcccggaggtacgtacctacgtttccgtacgtaccgtacccttacccggacggttacggaaccggggtacccaaacgtcccggtacccctaaaccgttccggtaaccgaaccccggtaccggaccccgggtaccccgggaccgtaacgggtcgtacgggtacgtaccggtacgggtacgaccgttaacgtaaccttacggttacccgtacggttaccgggaacggttaccggggtacgggacgggtaccgggtcggtacgttcgggtaccggttgggttaccggggccggttaacggccggttaacgtcccggtaccggtaccgtaccgtaccggaccgtaccgggtacccgaccggtccctcccgggtcccgttacccg

SEQ ID NO: 175284 - DNA, 811 bp, Homo sapiens
  misc_feature: GYAE6OF01EA0E5.51.26.C04.1.454.CMB.1.raw
  modified_base (666)..(666): a, c, t, g, unknown or other
  misc_feature (666)..(666): n is a, c, g, or t
tcagcgatcgtatacacgaccggtgctcgatttagtctagcgactttgggtttggggctgcccagcctgggcctcaggaagcagcatcggaggtgcctcagccatggcatggatccctctcttcctcggcgtccttgcttactgcacaggactccctggccgcctatcgacctgactcacgccctaccctcagtcgtcccgtcgtccccaggacagacacgcccaaccgactaccacctgccttcgtagggacgtaatttaaggttttcgggggtacttaaaggttagtttggttttaccggtagggttacttactaaaacctacgttacccgaaccccccgtaacggggcccccgggttacccccccgtaagtttaacccgtcggtccctttccctttaccttacgttcctaagttgaacgttcggaccccaaacgggtccccgggtaccccttacggaccggggtaccttccccgtggaccggtctagtttccctcgtccgggtccctacccgaaccgttccggtacggggaaccacgtaccggccctacgtctaccgaacctcggccccggggtacccggacccgtaggtccgtaggtacgggagtcggacggtctacgtactttacttcgtacgtccggagggttccgggaggggaaccggnggggacgtaccggtcggtcggtttaacgggtttccggggacgggttaaccggaccggttaggtaccccggttggtccccgggtacgtaccgggttccaaccgggtaccccggtaaggtaccccgtccccggtcccccgttaccgg

SEQ ID NO: 175285 - DNA, 876 bp, Homo sapiens
  misc_feature: GYAE6OF02FVTUJ.51.26.C04.1.454.CMB.1.raw
  modified_base (241)..(241): a, c, t, g, unknown or other
  misc_feature (241)..(241): n is a, c, g, or t
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccctaggacagacagccaccatcacctgctctggagataattgggtctaagtntgttcgtggtatcaacatcacccaggccgtccccgatactgctcctctatcatgactcgccgaaggccggccctacgacgggacttccccgtgacggcgtactttctcgtgggcctaccgtaaccgtcgttagggggaaccaccgtacggtacccctacttaccgtacggtaacccctacgttaccccggggacccggggaaccccccgtaaggggtacccgtttcgggtacggggtaaccgttaggggaaaccgggttccgttaacggttaaccgttttaacgttttaaacccgttacgggttaccggtacggggtaaccggggtttaaccgggggaaccggggttaaacgggggacgggggttaccccgtttacggggtacccgggttttaaacggtttttcccgggggtaacccgggggtaaaccgggggtaaccccgtaaccggggtttacccgttacccggggttaacccccggtttacccgggtttaaaccgggggttaccccgaaaaccgggttcccccccgggtaaaacggggttccccccggtttaccccggggtacccccccccccggttttaacggggtaccccccggttttaaccccggttcccgtttttaacccccccgggg

SEQ ID NO: 175286 - DNA, 677 bp, Homo sapiens
  misc_feature: GYAE6OF02FFZPL.51.26.C04.1.454.CMB.1.raw
  modified_base (276)..(276): a, c, t, g, unknown or other
  misc_feature (276)..(276): n is a, c, g, or t
tcagcgatcgtatacacgaccggtgctcgatttagtctagcgactttgggtttggggctgcccagcctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacacgccaccatccacctgctctggagtataagtttggggacttaagtatcgtttcgtggtatcaacntcacccaggcccggtcccgatactgctcctctatcatgactcgacaagccgccctgacgggactcccgtgacgcgtacttctctcggtcctaccgaacgttccgtacggggaaccacgacgccctaaccgtcgtacgtaccacgtacccggccgggtacccgacgggtccgtacgggtcggaacgtcggacgggtactacggaacctttacgtttaccgttcggtaccgacggggttccgggtaacggggtaacggaacgggggtacggccgttacgggtcggttaaccggttttccgggacgggtaacgggtaccgtaacggtccgtaccgggtaccccgttcgttaaccgggtccgaacggtacccggtaacggtcccgtaccggtcccccgttaccgg

SEQ ID NO: 175287 - DNA, 725 bp, Homo sapiens
  misc_feature: GYAE6OF02JJNHG.51.26.C04.1.454.CMB.1.raw
  modified_base (265)..(265): a, c, t, g, unknown or other
  misc_feature (265)..(265): n is a, c, g, or t
tcagcgatcgtatacacgaccggtgctcgatttagtctagcgactttgggtttggggctgcccagcctgggcctcaggaagcagcatcggaggtgcctcagccatggcatggatccctctcttcctcggcgtccttgcttactgcacaggatccctggccgcctatgacctgactcagcccaccctcacgtgtccgtagtcccccaggacaggaccacgccaccgatccgacctgctcgtggacattaagttcgggtactaagtnttggtttcgtagttactacgacacgttccaccgtacggccccggttcccgaattaccgtcggaccttccctacgttaacctcgtaactcgtacgttccgaccgtaaccgtcccggtaccctcggtaacggcctcccgttacgcgtaccgtactttccgtacgtacgtaccgtaccctacgtacgagggtaccacgacgtcctacgtaccgtcaaccgtaccgccggtaccggacccgagttccgtaggtgtaacgtcggtacggacgtacgtaacgttaccgttacggtacgaggtacgggttaccggacggggtaacgaacgggtacgtccgtacggttaacccgttagggttcccgggtacggggaactaccgttacgggtccgtaacggttacccgccggttaacggtcccgtaacgggtccccgtaaggtcccggttcccgacccggtttaaccgg

SEQ ID NO: 175288 - DNA, 573 bp, Homo sapiens
  misc_feature: GYAE6OF02H0CBI.51.26.C04.1.454.CMB.1.raw
  modified_base (223)..(223): a, c, t, g, unknown or other
  misc_feature (223)..(223): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
  modified_base (560)..(560): a, c, t, g, unknown or other
  misc_feature (560)..(560): n is a, c, g, or t
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccctaggacagacagccaccatcacctgctctgganataatttggggctaagtatgtttcgtggtatcaacatcacccaggccggtccccatactgctcctctatcatgatgaccaagcgaccctcaagggctcccnggacgngtactttctcngggtcctcctaactctggggaaccacgagcccnctacgtgacccagtacccgaccgggacccgacggcgtggtggagtacggacggtctagacgttacttacttcgtcgacgggcgtgggacgagggaggcgtaggtcgacgttttcggcggtagggacgacgtcgttacggaccggtccgtcgtacgtacgacccgacgcggtccgccctccggtccnccgttaccgtccg

SEQ ID NO: 175289 - DNA, 531 bp, Homo sapiens
  misc_feature: GYAE6OF01CTDYF.25.55.E11.1.454.CMB.1.raw
  modified_base (500)..(500): a, c, t, g, unknown or other
  misc_feature (500)..(500): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttctggctccaagtctgggactacggccactctcattattcgtggacccaggatgtggatgaaggtgtctatttctgtcagctgtgggacggcaccgtcgcggtcgttcgggcggggcacccgaggctcgaccgtccgtgggtcagcccaggctcgcccctcggtcnctctcgttccccaccctcctcactgtctacg

SEQ ID NO: 175290 - DNA, 808 bp, Homo sapiens
  misc_feature: GYAE6OF01C05LH.25.55.E11.1.454.CMB.1.raw
  modified_base (323)..(323): a, c, t, g, unknown or other
  misc_feature (323)..(323): n is a, c, g, or t
  modified_base (349)..(349): a, c, t, g, unknown or other
  misc_feature (349)..(349): n is a, c, g, or t
tcagactgtacagtcacgaccggtgctcgatttagcactcgcacgttgggtttgggcgtgggcctcacggaagcagcatcggaggtgtcctcagccatggcatggatccctctcttcctcggcgtccttgcttactgcacaggatttgtgacctcctattgagttgacccagcctccgtcggtgtccgtctcttcgggccagacgagccagcctcccctgcgtcctggaccttaaagtgggcagaagtctgtatgttggtatcagttgaggccggtcggtctccgactctagtcagtgtttccaatatgagtagacggccctnagggtattcccgtgtacccggttttntgggcttaccgaagttcgtacggggtaacttaacgggccctaacttctaccaattttaaacttcggttacggggaaccccctaaaggggtaactttggtaggggtaacttacggtaaaaggggtttcggttacccttaaaggttttttcccttaggtttacccaaaggtacccgttagggttcggggaacgggtcccgtaacccggtttacccgggtaccggggttccgtttccggggggtacccgggggggtccctaacccccggaaacgggcccttagggtaaacccccggttacccggttccggggttacccgacggttacccccgaaaagggtcccgttacccggtccccccggttacgggtacccgtaacccgttcccggtttaccgtttaacccccccgtacccccgtttaccccgttaccgtaacccggtttcgggtaaccgttaacccggg

SEQ ID NO: 175291 - DNA, 642 bp, Homo sapiens
  misc_feature: GYAE6OF01EI23L.25.55.E11.1.454.CMB.1.raw
  modified_base (529)..(529): a, c, t, g, unknown or other
  misc_feature (529)..(529): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaaggtgggcagaagtctgtatgttggtatcagttgaggccggccggtctccgactctagtcatgtttcaacatgatagaccggccctcgagggtactttcctggtacccggtttttcgtggtccttccgaaagtccgtggggaccttaccggcccactcctctaagtttacgttccggtggggaacccctagggtattgggtggtaatggtaagggttgttcttattttcgtcgttcgtacgtcgttggtggggaccggccgacccggtcggtccgggttcgttcggggcggggccacccgngccgtcggacccgtccgtgggtccacgccccgaacggccgtccggccccccttgggtccctaccgttccgttccgttcccccgtccccttccctcctaccttgtaccgtacgg

SEQ ID NO: 175292 - DNA, 567 bp, Homo sapiens
  misc_feature: GYAE6OF01CYA0Z.25.55.E11.1.454.CMB.1.raw
  modified_base (529)..(529): a, c, t, g, unknown or other
  misc_feature (529)..(529): n is a, c, g, or t
  modified_base (556)..(556): a, c, t, g, unknown or other
  misc_feature (556)..(556): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcgagggattccgtgtacccggttttctgggctccgaagtcgtagggactacggccactctctattattcggtcgggaccctaggactgtggatgaaggtgtctatttctgtcagtcgtggtgggacggcacccggtcgcggtcgttcggcggggcacccgagtcgtcgtaccgtccgtgggtccacgcccgacggcctcggcccccgtcggtccncttccgtccgttcccacccctcctccnctgtacgtacg

SEQ ID NO: 175293 - DNA, 552 bp, Homo sapiens
  misc_feature: GYAE6OF01EKRAW.25.55.E11.1.454.CMB.1.raw
  modified_base (387)..(387): a, c, t, g, unknown or other
  misc_feature (387)..(387): n is a, c, g, or t
  modified_base (541)..(541): a, c, t, g, unknown or other
  misc_feature (541)..(541): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagagtctgtatgttggtatcagttgaggccgggccggtctccgactctagtcatgtttcaacatgatagacggccctcagggattcctgaccggttttctggctcgaagtctggctcctcggcctcccgtgccatcagtggctccggtcgnggatgagctgatattacgtgtgcgtagtttggatgccagtctgagtggtccgcggtgttcgggcgggacgggaccaggcgtcgaccgtccgtaggtccgacgcccgaacggcctaccgtccccccgtacggtcctacccgtcttccgttccccnccccgttcccg

SEQ ID NO: 175294 - DNA, 612 bp, Homo sapiens
  misc_feature: GYAE6OF01AKPEQ.25.55.E11.1.454.CMB.1.raw
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacatttggtgcttataactntgtctcctggtcccaacaacacccaggccaacggcccccaaactcatcatttangatgtcagtcatcggccctctggtagtttctggtcgcttctctgctccagtctggcactcggcctccctgaccatccgtcggggcctccgaggtcctggacgggacgacgggtccttaacgtttatttattcgtactacttttcaattacaagaagaaccaacccgaaactacgttacgttgggttacggtttaccggacgggtacgggaccgtaaaggttcggaacccgttccgtacggtaccgacggaccccgaaaggcccgtaccggccccccgttacgggtccctaccgttccttaccccg

SEQ ID NO: 175295 - DNA, 544 bp, Homo sapiens
  misc_feature: GYAE6OF01AXXVS.25.55.E11.1.454.CMB.1.raw
  modified_base (484)..(484): a, c, t, g, unknown or other
  misc_feature (484)..(484): n is a, c, g, or t
  modified_base (507)..(507): a, c, t, g, unknown or other
  misc_feature (507)..(507): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcgagggattccgtgtaccggttttctggctccaagtctgggactacggccactctctattattcgtgggacccaggatgtggatgaaggtgtctatttctgtcagtctggtgggacggcgaccgtcggcggtcgtcgggcggggcacccgagctcgccgtccgtggtccngcccaggcctcgcccccgtgccncgtcctcgttccccgtccctcctccactcgtctacgg

SEQ ID NO: 175296 - DNA, 555 bp, Homo sapiens
  misc_feature: GYAE6OF01CRI5J.25.55.E11.1.454.CMB.1.raw
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
  modified_base (510)..(510): a, c, t, g, unknown or other
  misc_feature (510)..(510): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtgggcagagtctgtatgtgtatcagttgaggccggcgtctccgatctagtcatgtttcaacatgatagacggccctnagggattcctgacccggttttntggctccaagtctgggactacggccactctcattattcgtgggacccagggatgtggatggaaggtgtctatttctgtcagtctggtgggacgcgaccgtcgcggtcgttcgggcggggcacccgagcgtcgaccgtccgtgggtccacggcccgaaggccgtccgtcccccgtggtcccnccgtccttcggttcccccacccttccctccaccttcgtactacgg

SEQ ID NO: 175297 - DNA, 529 bp, Homo sapiens
  misc_feature: GYAE6OF01ADKZU.25.55.E11.1.454.CMB.1.raw
  modified_base (499)..(499): a, c, t, g, unknown or other
  misc_feature (499)..(499): n is a, c, g, or t
  modified_base (521)..(521): a, c, t, g, unknown or other
  misc_feature (521)..(521): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagagtctgtatgttggtatcagttgaggccgggccggtctccgactctagtcatgtttcaacatgatagacggccctcagggattcctgtaccggttttctggctccaagtctgggactacggccactctcattattcgtgggacccaggatggtggatggaaggtgtcttatttctgtcagctgtgggacggcaccgtcgcggtcgtcgggcggggcaccgagctcgccgtcgtggtcacgcccaggctcgcccctggtccnctctcgtccccgccctcctccnctgtctcg

SEQ ID NO: 175298 - DNA, 928 bp, Homo sapiens
  misc_feature: GYAE6OF01B0NQF.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacgaggtatttgtgacctcctatgagttgacccagcctccgtcggtgtccgtctcgttcgggccagacagccagccctcccctgcctctggtaccttaaaggtggggcagaagtctgtatgttggtatcagttgaggccgggccgtctccgactctacgtcatgtttacaacatgatagaccggccctcgagggtactttccgtggttacccggttttctcgggtcctaccgtaaggttccgtacggggtacctacccgggaccctaccgttcctacgtaactttacgtttccggtacgggggtaacccccgtaggggtaacgttgggttacgggtaagttacggggtaaaagggtttcggtttaccgttttaaagttttttccgttacgggtttacccgtaacgggtccggttttacggggtttaccggggggtaacccggggttacccgttaaccccccggggtttcccggggttcccggggggtttccccgggttttacccggggggggccccggggggggtaccccgtaaacccccccgggtaacggggttaccccgggttaccggggtaaccccccgggtttccccgggttaccgggggttaccccgaaccccggggtaccccccgtaaaaccgggggtccccggtttcccccgggtaccccccccccggtttcgggggttacccccctaaccccggtttccccgtttccccgggtttacccccccctaacccccgtttccccccgttacccttaaccccggtttcgtaaccccggtttaacccggg

SEQ ID NO: 175299 - DNA, 528 bp, Homo sapiens
  misc_feature: GYAE6OF01A2ITJ.25.55.E11.1.454.CMB.1.raw
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (493)..(493): a, c, t, g, unknown or other
  misc_feature (493)..(493): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtgggcagaagtctgtatgttggtatcagttgaggccggcggtctccgactctagtcatgtttcaacatgatagacggccctnagggattcctgaccggttttcnggctccaagtctgggactacggccactctcattatcgtggacccaggatgtggatgaaggtgtctatttctgtcagctgtgggacgcaccgtcgcggtcttcggcggggcacccgagctgaccgtctcgggtcagcccaaggcctcgccccctggtccnctcctcgttccccgcccttcctccactgtactacg

SEQ ID NO: 175300 - DNA, 529 bp, Homo sapiens
  misc_feature: GYAE6OF01B5VD9.25.55.E11.1.454.CMB.1.raw
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (522)..(522): a, c, t, g, unknown or other
  misc_feature (522)..(522): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccgtgactcagcctgcctccgtgtctgggtctctggacagtcgatcaccatttcctgcactggactcagcactgatgttgctaggttattactttgtctcctggtaccaacaacacccaggcaaacgcccccaaacttatcatttatgaggccactaagccggccctcaggagtttactaatcgtcttctctggctcaagtctggcagcacggcctcctgacatctcgtggtctccaggctgacggacgagtctagattatactgctactcatatggacacatcaactaactcccgtctccggactcgggaccacgggtccnccgttccgnggtccacgacccgacgacccaacccactcgtcncttcccg

SEQ ID NO: 175301 - DNA, 769 bp, Homo sapiens
  misc_feature: GYAE6OF01BEFBF.25.55.E11.1.454.CMB.1.raw
  modified_base (253)..(253): a, c, t, g, unknown or other
  misc_feature (253)..(253): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactntgtctcctggtcccaacaacaccaggcaacggccccaaactcatctatttatgtatgtcagtcacgtccgccctcgtggtagtttcgtggtcgtcttctcgtggtcctcctaagtcgtggacctaacgtccggtccctcccgtcgtaccctacgtccggtccggggtccttccggaggtccgtacggaacgggtaccggtaacgggtacctttaacgtttaagtttacgtttcggtacctttaacttttaccgtaacgttaaccgtaacgggtaaaccgtaaacccgtaaaccccgtaaaccgttaaccggtttaccggtttacggggtttaccggggtttaccggggacccgggggttaaaccggggtaaacccgttaaacgggtttacccgggtaaccccggttcccggttacccgggttacccgaaccgggtacccccggtaaacgggtccccgttaccccgggtcccccccgttacgggttcccctacccgtttcccggtttaccccccggg

SEQ ID NO: 175302 - DNA, 679 bp, Homo sapiens
  misc_feature: GYAE6OF01DML1T.25.55.E11.1.454.CMB.1.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (335)..(335): a, c, t, g, unknown or other
  misc_feature (335)..(335): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctctcactcagggcacagggtcctgggcccagtctgccctgactcagcctgcctccgtgtctgggactcctggacagtcggtcaccatctcctgcactggaaccagccgtgacattggtncttataactntgtctctgtcccaacaacaccaggcacggaccccaaactcatctatttatgtatgtcagtcactcggccctgtggtagtttcgnggttcgtctttctcgtcggtcctccgtaaagttctacggtacaacccgttcccggccccttccccgttgaacccctacgttccggttccgggggcccttccccgaagggtccgtagggacggaacgggtaacgggtacctttaaccgttttaatttaacgttcgacttaacttttccaattaaccgagtaacgaaccaacctaacgtacgttcgttaggttcgttccgggacgggtaacggtaaccgtaagtttccgggacccggttccgtaccggtccgaacggtccccgaaaggcccgttcccggtaccccccgttcggttaccgaccgttccgttccccgg

SEQ ID NO: 175303 - DNA, 651 bp, Homo sapiens
  misc_feature: GYAE6OF01A4MDJ.25.55.E11.1.454.CMB.1.raw
  modified_base (227)..(227): a, c, t, g, unknown or other
  misc_feature (227)..(227): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcggtcaccatctctgcacgtcggaaccngccgtagactagttggtgtacttaataactatcgtctcctcggtacccaacaaccacccgagacgaaccggaccccaaactcatctatttagtgtatcgtcagtactacgtccggtccctcgtggttacgtttcgtcggtccgtcttctcgtcggtccttaccgtaagttcgtcggtacctaaccgtccgtccctcccgtaccgacctacttcccggtccgggtcctccgacggtccgtaggacggacgacggtcttaactttagtttacttcgtacttactttcattaaccgaagaacgaacctaaccaacgtacgttcgtgggttcgtcgggcggacggtaactacggttcgacccggtcgtccgtacgaccgacccgaaggtccgtcccgtccccgttacgtccaccgttccgttccccgg

SEQ ID NO: 175304 - DNA, 675 bp, Homo sapiens
  misc_feature: GYAE6OF01AW1SX.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtccaacaacaccagcaacggccccaaatcatcatttatgatgtcagtcactccggccctcgtggtacgtttcgtggttccgtctttcctcttcggccttaccgtaacgtctacggtacctaaaccgtccggtacccttcccgtacgtaaccctacgttccgtccggggtcctaccgtacggtccgtaggaacggacggtacggtacttaacgtttacttagttcgtacttactttacaattaacgaacgtaacgaacctaacctaacgtacgttacgttcgggttacggttacgggacgggtaacgggtaaccgtaacggttcggtacccggttccggtccgggtacgaccggacccgaacgggtcccgttacccggtcccccgttacggtaccctaccgttcccgttccccgg

SEQ ID NO: 175305 - DNA, 553 bp, Homo sapiens
  misc_feature: GYAE6OF01EP0XT.25.55.E11.1.454.CMB.1.raw
  modified_base (474)..(474): a, c, t, g, unknown or other
  misc_feature (474)..(474): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
  modified_base (544)..(544): a, c, t, g, unknown or other
  misc_feature (544)..(544): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtgggcagaagtctgtatgttggtatcagttgaggccgggccggtctccgactctagtcatgtttcaacatgatagacggccctcgagggtacttccgtgtaccggttttctcggtctccaagtctgggactacggccactctcattagtcgtcggacccaggatgtggatggaaggtgtacttatttctgtcagtctgggtcgggacggcgaccggtcgcggtcgttcggggcggggcacccgngtcgtcgaccgtcgngggtcngcccaggccncggcccctggtccncctctcgtcccctaccctcctaccnctcgtctcg

SEQ ID NO: 175306 - DNA, 712 bp, Homo sapiens
  misc_feature: GYAE6OF01BTP7D.25.55.E11.1.454.CMB.1.raw
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggngcttataactatgtctcctgtcccaacaacaccagcaacggcccccaaactcatcatttangatgtcagtcatcggccctcgtggtactttctggtctcttctcgtggctcaagtctaggcaactccggcctccctgaccatccgtcgggccttccgacggtctggacggacgtacgggtaccttaacgtttacttagtttcgtacttaactttttccaacttaaccgaagtaacgaaacccgtaaacccgaaccgtaacgtttacggttacggggtttacggttaccgggggaaccggggtaaccgggggtaaacccttaaacgggttccggtaaacccccggttccggttaccccggggttaccgaacccgggtacccccggtaaaacggggtcccccgttaccccgggtaccccccccggtttacccgggtaccccgttaacccgtttccccggttttaccccccggg

SEQ ID NO: 175307 - DNA, 743 bp, Homo sapiens
  misc_feature: GYAE6OF01EKTSK.25.55.E11.1.454.CMB.1.raw
tcagactgtacagtcacgaccggtgctcgatttagcactcgcacgttgggtttggggctgggcctcagtaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctccctgctctggccttaagtgggcagagtctgtatgttggtatcagttgaggccgggccggtctccgactctagtcattgttcaacatgataggaccggccctcgagggtactttccgtggtacccggttttctcgggtcctaccgtaagttcgtacggggacctaccgggcctaacttctactatttacgttcggtcggacccagggtatcggtaggtagtggtaagggttcgttacttatttcgtgttcgtacgtcgttgggtcggggaccggtccgtacccggttccggtccgggttccggtccggggccgggggtacccaccccggtacggtccggttaccgggtacccggttcccggtacgggggttcccacgggtacccccggtaaacgggtccccgttacccgggtccccccccggttaccgggttccccgtacccggtttccccggttccccggttttccccccccggtcccccgtttacccccgttaccccgtaacccggtttaccggttacccgttaaccgggg

SEQ ID NO: 175308 - DNA, 530 bp, Homo sapiens
  misc_feature: GYAE6OF01BRIUJ.25.55.E11.1.454.CMB.1.raw
  modified_base (458)..(458): a, c, t, g, unknown or other
  misc_feature (458)..(458): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtgggcagagtctgtatgttggtatcagttgaggccgggccggtctccgactctagtcatgtttcaacatgatagacggccctcgagggattcctgtaccggttttctggcctccaagtctagggactacggccactctctattattcgtgggacccaggatgtggatgaaggtgttctatttctgtcagtctggtggacgcacgtcgcggtcgttcggcgggcaccgngctcgaccgtcgtggtcacgccgacgctcgcccctcggtcnctctccgttcccnccctctcnctcgtcgtcg

SEQ ID NO: 175309 - DNA, 547 bp, Homo sapiens
  misc_feature: GYAE6OF01ATULS.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattccctgacccggtttttctggctccaagtctgggactacggccactctcattatcgtgggacccaggatgtggatgaaggtgtctatttctgtcagctgtgggacggcaccgtcgcggtcgttcgggcggggcacccgagccgtgaccgtccgtggtcacgcccgaaggcctcggccccctggtccacctcctcgttcccccacccttccctccacctgtactacg

SEQ ID NO: 175310 - DNA, 612 bp, Homo sapiens
  misc_feature: GYAE6OF01BQ75O.25.55.E11.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacatttggngctttaanaactatgtctcctggtcccaanaacacccaggccaacggcccccaaactcatcatttangatgtcagtcatccggcctgtggatttctggtcgcttctcgtggctccagtctggcacgtcgcctcctgccatccgtcgggctccgaggtctaggacggacgacggtacttacgtttatttaattcgtactattttactaattaaccgaagtacgaacaacccaaacgtacgtaccgttgggttacgttaccgggacgggtaagggtaacccgtaaggttcgaacccggttccgtaccggtaccgacggccccgaaagggtccctccggaccccccgttagggccctaccgttccgttcccgg

SEQ ID NO: 175311 - DNA, 589 bp, Homo sapiens
  misc_feature: GYAE6OF01D7B7V.25.55.E11.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (446)..(446): a, c, t, g, unknown or other
  misc_feature (446)..(446): n is a, c, g, or t
tcagactgtacagtcacgaccggtgctcgatttagcactcgcacgttgggtttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccngccgtgacattggtncttaataactntgtctcctgtccaacaacaccagcaacgccccaaatcatcatttatgatgtcagtcatccggcccttgtggtagtttctggtccgtctttctcgtggcctccaagtcgtggacctaacgtccggccctccctgacctatccgtcgggcctccgaggctggacggacgagtctactttattatgactatttnaatacaagacgaaccaaccgaactgttcgttgggtacggttcggcgggaacggtaccgtaagttccgaccgttccgtggtacccgacggaccccgaaggtccctccggccccccgttggtaccctaccgttcccgttccccgg

SEQ ID NO: 175312 - DNA, 577 bp, Homo sapiens
  misc_feature: GYAE6OF01ASPFU.25.55.E11.1.454.CMB.1.raw
  modified_base (337)..(337): a, c, t, g, unknown or other
  misc_feature (337)..(337): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (564)..(564): a, c, t, g, unknown or other
  misc_feature (564)..(564): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcggccagacagccagcctcccctgctctggccttaagtgggcagagtctgtatgttggtatcagttgaggccgggccggtctccgactctagtcatgtttcaacatgatagacggccctcgagggattccctgtaccggtttttcngggcctccgaagtcctggggactacggccactctcattacttcgtcgggacccagggatggtggatgaaggtgtcttatttctgtnagctgngggacggcaccgtcgcggttcgttcgggcggggtccacccgagtccgtcggacccgttccgtggggtcacggcccgaagggcctccggcccccgtcggtcccgaccgttctaccgttccccacccttccctaccnccgttgtcctacg

SEQ ID NO: 175313 - DNA, 727 bp, Homo sapiens
  misc_feature: GYAE6OF01AL8YA.25.55.E11.1.454.CMB.1.raw
  modified_base (339)..(339): a, c, t, g, unknown or other
  misc_feature (339)..(339): n is a, c, g, or t
  modified_base (675)..(675): a, c, t, g, unknown or other
  misc_feature (675)..(675): n is a, c, g, or t
tcagactgtacagtcacgaccggtgctcgatttagcactcgcacgttgggtttggggcgtgggcctcaggaagtcagcaatcggaggtgccctcagccgatggcatggatccctctcttcctcggcgtccttgcttactgcaccaggatttgtgaccctcctagtgaagttcgaacccaggcccttccgtcgggttcgtccgtcctctttccgggcctagacacgccacgccctcccctgcctctcggtcccttaaaggtcgggcagaagtcgtgtacttggttggtatcgtaggttgacggccgggtcgttctccggactctagtcatcgttacaacngtgataggaccgtccctcgtagggtactttccgtacgttaccggttttacgtcgggcccttaccgtaaacggtttcggtaccggggtaaccgtaacccgggaccctaacccttccgttactaagttttaccgttacgttccgggggaaacccctagggtacgttcgtggtacgttaggtaacgggttgttccgtttaagtttcgtcgttcgacggtcgttaggtcgggaccgtccgtaccggtcggtcggttccggttcgggcggggccaccgagtccgtacgtcccggtccgtgggtaccacgtcccgacgtccgtaccggccccgtaggtcccnccgttccgttccggtccccccgtaccttccctaccgtacgtcggtaactcgg

SEQ ID NO: 175314 - DNA, 656 bp, Homo sapiens
  misc_feature: GYAE6OF01A3PMA.25.55.E11.1.454.CMB.1.raw
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
tcagactgtacagtcacgaccggtgctcgatttagcactcgcacgttgggtttggggctgggcctcaggaagcagcatcggaggtgcctcagccatggcatggatctctctcttcctcggcgtccttgcttactgcacaggatttgtgacctcctatgagttgacccagcctccgtcggtgtccgtctcgttcgggccagacagccagcctcccctgctctggccttaaaggtcgggcagaagtctgtagtgttggtatcagttgaggccggccgtctccgactctagtcatgttacaacntgatagacgcctgaggnttcctgtaccggtttcnggtctacgagtcgtgggacctacggccctacgtcctactactttacgtttccggtcgggaaccccagggtacgttgggtaggtacgttaggtaagggtttgttacttagttttcgtcgtcgtagttcgtgggtcgggtaccggccgtaccgtcgggtccggttcggtccgggccgggggtaccacccgtacggtccgttcgacccggtccgtcgggcctacggacccgtaacgggccgtcccggacccccgttcgggtccctcccgttccgttcccgttaccccctaccccgttaccctaccgtaccgttcggttaacccg

SEQ ID NO: 175315 - DNA, 550 bp, Homo sapiens
  misc_feature: GYAE6OF01DNU16.25.55.E11.1.454.CMB.1.raw
  modified_base (341)..(341): a, c, t, g, unknown or other
  misc_feature (341)..(341): n is a, c, g, or t
  modified_base (486)..(486): a, c, t, g, unknown or other
  misc_feature (486)..(486): n is a, c, g, or t
  modified_base (524)..(524): a, c, t, g, unknown or other
  misc_feature (524)..(524): n is a, c, g, or t
  modified_base (540)..(541): a, c, t, g, unknown or other
  misc_feature (540)..(541): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaagtgggcagaagtctgtatgttggtatcagttgaggccgggccggtctccgactctagtcatgtttcaacatgatagacggccctcgagggatttccgtgtacccggtttttcngggtctaccgaagttcgtgggtacctacggcctaactctactattacttcggtagggacccagggtatggtggatggaaggtgtcttatttctgtcagtcgtggtcgggacgcacggtcgtcggtccgttcgggcggggcaccgngcgtcgaccgtcgtggtcacgccaggctcgccctgtcnctctgtccccgcctcnnctgtctacg

SEQ ID NO: 175316 - DNA, 560 bp, Homo sapiens
  misc_feature: GYAE6OF01DXRQE.25.55.E11.1.454.CMB.1.raw
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccggccggtctccgactctagtcatgtttcaacatgatagacggccctnagggattcctgaccggttttcnggctccagtctgggactacggccactctctattattcgtggacccaggatgtggatgaaggtgtctatttctgtcagtctggtgggacggcaccgtcgcggtcgttcgggcggggccacccgagcgtcgaccgtccgtcgggtcacgcccgaacggcctccggcccccgttcggtcctaccgtccgttccgttccccgtcccctccctccacctgtacgtacgg

SEQ ID NO: 175317 - DNA, 574 bp, Homo sapiens
  misc_feature: GYAE6OF01DYCNV.25.55.E11.1.454.CMB.1.raw
  modified_base (337)..(337): a, c, t, g, unknown or other
  misc_feature (337)..(337): n is a, c, g, or t
  modified_base (487)..(487): a, c, t, g, unknown or other
  misc_feature (487)..(487): n is a, c, g, or t
tcagactgtacagtcacgaccggtgctcgatttagcactcgcacgttgggtttgggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtgggcagaagtctgtatgttggtatcagttgaggccgggccggtctccgactctagtcatgtttcacatgatagacggccctgagggattcctgtaccggttttcnggtctccaagtctgggactacggccactctcattattcgtgggaccccaggatgtggatgaaggtgtcttatttctgtcagtctggtggacggcaccgtcggcggtcgttcgggcggggcacccgagtcgtcgaccgtcgtcgggtaccncgcccgaaggcccgtcgtccccccgtcggtcctacccgttccgttccgttccccctacccttccctaccgtaccttcgtacctacgg

SEQ ID NO: 175318 - DNA, 526 bp, Homo sapiens
  misc_feature: GYAE6OF01C9P7O.25.55.E11.1.454.CMB.1.raw
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (515)..(515): a, c, t, g, unknown or other
  misc_feature (515)..(515): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaacggccccaaactcatcatttangatgcagtcatcgcctntgagtttcngtcncttctctgctcaagtctggcactcgcctcctgaccatccgtcgggcctccgagctagaggacgaggtcttacttattattgctatttcatacagaacgacaaccaactgtctggttcgtcgggacggacggacgaagttcgaccgtccgtgtcgacgtcccaaggcctcgccccctggtcncgtccgtcccg

SEQ ID NO: 175319 - DNA, 529 bp, Homo sapiens
  misc_feature: GYAE6OF01D5XBE.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtacccaaacaacacccaggcaacggcccccaaactcatcatttatgatgtcagtcatccggccctctggtagtttctggtcgcttctctgctcaagtctggcactcgcctcctgaccatcgtcgggctccgaggctagaggacgaggcttacttattattgctatttcatacagaagacaccaacgtagtctggtcgtcgggcggaggacctagttgacccgtcgtcgtcacgcccgaaggcctcgcccctgtccacgtcgtcccg

SEQ ID NO: 175320 - DNA, 609 bp, Homo sapiens
  misc_feature: GYAE6OF01B7C1L.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggaccttaaaggtgggcagaagtctgtatgttgtatcagttgaggccgggccggtctccgactctagtcatgtttcaacatgatagacggccctgagggtattcctgtaccggttttctggtcctccgaagtctgggactacggccactctctatttacgttcggtacgggacccagggtacttggtaggagtaggtaagggttgttacttagttttctgttcagtcgtggtcggggaccggtccgaccggtcggtccgggttcgttccggggcgggggccacccggagtccgtcggaccgttccgtgggtccacgcccgaaggcctccgcccccgtcggtccctacgtccgtccgttcccctaccctccctaccaccttcgtctacgg

SEQ ID NO: 175321 - DNA, 672 bp, Homo sapiens
  misc_feature: GYAE6OF01C0QI6.25.55.E11.1.454.CMB.1.raw
  modified_base (562)..(562): a, c, t, g, unknown or other
  misc_feature (562)..(562): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcgttcgggccagacagccagccctcccctgcctctcggaccttaaaggtggggacaggtaagtctgtattggttgtatcgagttggaggccgggccgtctccgactctagtcatgtttacaactagtgatacggaccggtccctagacgggtactttccgtcggttacccggttttcgtcggccttaccgaaggttccgtacggggtaacctaccggcctaacttctacttactttagttccggtcggggtaaccctaggtacttggtaggaagtaggtaaggttcgttacgttatttcgtgtctaggtctagggtcgggacgccgtaccggtcggtccgggttccgttcggggccgggaccacccgagtccgngtacccgtccggtcggtaccgacgtacccgaacggtccgtcccggtcccccgtggtcctaccgttcccgttccgttccccgtccccttcctaccgacttcgtacctacgg

SEQ ID NO: 175322 - DNA, 683 bp, Homo sapiens
  misc_feature: GYAE6OF01B9YC8.25.55.E11.1.454.CMB.1.raw
  modified_base (303)..(303): a, c, t, g, unknown or other
  misc_feature (303)..(303): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctcgtcggtgtccgtctcgttcgggccagacagccacgcctccctgctcgtggtaccttaaagtggggacagagtctgtatgttgtatcgagttgacggccggccgtctccgactcgtagtcatgttacaacntgagtacggaccggtccctagacgggtacttccgtcggttacccggttttctcgggtccttaccgaaggttcgtacggggacctaccgggcctaacttccgtacttacgtttacgttccgggtcggaccctagggtacttggtcggtaagtggtaagggttcgttacttagtttctggtctaggtcgtgggtacgggaccgtacgtcccggttcgggtcgggttaccggttccgggggccggggtacctacccggacggtccgtacggtccccggtcggtcgggtccgacggccgaccgtccgtcccggccccgttcgggccctacgttcccgttcccgtcccccgtcccgttaccttacctccggttagtccgtacggg

SEQ ID NO: 175323 - DNA, 911 bp, Homo sapiens
  misc_feature: GYAE6OF01AEABW.25.55.E11.1.454.CMB.1.raw
  modified_base (244)..(244): a, c, t, g, unknown or other
  misc_feature (244)..(244): n is a, c, g, or t
  modified_base (342)..(342): a, c, t, g, unknown or other
  misc_feature (342)..(342): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctcctgcactcggaaccagccgtgactagtttggtntctttaataacttagttggttccttcccgttcggttaccccaaacgaaacccaccccgaaggccaaacggccccctaaaactccaactactattttangacttgtccagtcacgtccggtccctcgtggttacgttttcgtcggttccgtactttcgtcgttaggtccttaccgtaaacgttcgtacggtaccaaccgttcccgggccctttccccgtacgtacccgtacgttccggttccgggggtcctccgtaacgggtcgtacggacgggtacggtacgggtacctttaacgtttacgtttaacgtttcggtactttacgttttaccgtaacgttaaccgtaaggtaaccgtaaacccgtaacccgttaaaaccggtaccggtttaccgggtttacggggtttacccggggtttacccggggtaacccggggggtaaccgggggttaaaccccggttaaacggggtttttaccccggggtaaccccccggggttttaccccgggtttacccccgggggttaaccccggtaaacccggggttacccccccggttaaaaccccgggggttcccccggtttaaccccccggggttaccccccccccggtttaacccgggttacccccggtttaaccccgttttacccccggttttccccccccgggg

SEQ ID NO: 175324 - DNA, 831 bp, Homo sapiens
  misc_feature: GYAE6OF01D2HHP.25.55.E11.1.454.CMB.1.raw
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacccttcctatgagttgaccccgngtcctcggtcggtcgtccgtctcgtcggcagacncgccncgtccctcctgctcgtcgtacttaaggcgggacagtactcgtagtattggttagtatcgtaggtggacgggtccgggtccgtctccgtactcgtagtctagtttcgttacaactagtaggaactacgggcccgtaccctacggacgggttacctttcccggtacgggtttacccggttttcggccggttaccctaaccggtaacggttccggtacggggtaaccgtacccggtaccctaccgttccttacgttacgttttacgttccggggtaccggtaacccgtaagggttagttcgggtaaggtacgttaagggtaacggtttcgtttactttacgtttcgtacgtcgtagttccggttaggggtaccgggtccgtacccgtacccgggtcggttacccgggttccgggttccggggggacccggggtacccaacccggtcggtccgttaccgggtacccgttccgggtacgggtaccacccgggtaccctacggtccggtacccgttcccccggtcccccgggtttaccgtcccgttacccgtttccccggtttacccccggtttcccccccgtaccccgttaccccgtacccggttaccgttaccggttaacccgg

SEQ ID NO: 175325 - DNA, 613 bp, Homo sapiens
  misc_feature: GYAE6OF01CDRU2.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgcctctggccttaaaggtggggcagaagtctgtatgttgtatcagttgaggccggcgtctccgatctagtcatgtttcaactatgatacggaccggccctcgaggggtactttcccgtcggtacccgggtttttctgggccttaccgaaggttcgtacggggtacctacggccctaacgttctcctaatttacgttccggtcgggacccagggtacgtgtggtagtggaaggtgtcttatttcgtgtcagtctggtcgggacgcgaccggtcgcggtcgttcgggcgggccgacccgagccgtcggccgtccgtggtccgacgcccgacggcctccgtcccccgtcggtcctccgtcctccgttccccctaccccttccctacctcctcgtacgtacg

SEQ ID NO: 175326 - DNA, 782 bp, Homo sapiens
  misc_feature: GYAE6OF01D9IST.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgcctctggccttaaagtgggcagagtctgtatgttgtatcagttgacggccggccggtctccgactctagtctattcgttacaacatgagtacggaccggccctcgacgggtatttcccgtcggtacccggtttttcgtcggtcctaccgtaagtccgtacgggaccgtaccggcctaccttctactaatttacgttccggtacgggaacccgtagggtacgtaggttagggagtaggtaagggttcgttacgtttacgtttcgtcggttcgtacggtcgtgggttacggggaccggtacccgtacccgggttccgggtcccgggtttcccgggttccggggggcccggggggacccgtaaccccggacggtcccggttaccggtaccccggttcccgggttacggggtacccggaacccggccccggtaaaccgggtcccgtacccccgggtccccccggttacccgggttacccgtaccccgttcccgtttccccggttaccccccccgttacccctttacccccgttacccctaacccggtttaccggttacccgtaacccggg

SEQ ID NO: 175327 - DNA, 555 bp, Homo sapiens
  misc_feature: GYAE6OF01BZJ88.25.55.E11.1.454.CMB.1.raw
  modified_base (456)..(456): a, c, t, g, unknown or other
  misc_feature (456)..(456): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggcggtctccgactctagtcatgtttcaacatgatagacggccctcagggattcctgtaccggttttctggctccaagtctgggactacggccactctcattatcgtggaccccaggatgtggatggaagtgtctatttctgtcagctgtgggacggcaccgtcgcggtcgttcggcggggcacccgngcgtcgaccgtccgtgggtccaggcccgaacggcctccggccccctcggtcctaccgtcctacggttcccccgtccctccctccacttcgtacctacgg

SEQ ID NO: 175328 - DNA, 745 bp, Homo sapiens
  misc_feature: GYAE6OF01C5QV0.25.55.E11.1.454.CMB.1.raw
  modified_base (228)..(228): a, c, t, g, unknown or other
  misc_feature (228)..(228): n is a, c, g, or t
  modified_base (322)..(322): a, c, t, g, unknown or other
  misc_feature (322)..(322): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctggactcctggacaggtcgtcaccatcctcctgcacgtggaaccngccgtgactatttggcgtacttaagtaactattcgttcctcctcggtacccaacaaccacccaggccaaccggaccccaactcatctactttangtaatcgtacacgtcacgtccggtccctcgtcggtacgtttcgtcggttccgtctttcgtcgtcggccttccgaacgttcgtggacctaaccgttccggccccttccgtacgaccctgtacccggtccggggtcccttaccggacggcgttacggaacggtaacggtacggtacctttacgtttatttacgttcgtacgtttactttacgaactttacgaacgtaaacgaaaccctaacccgtaaacgtacggttacgttacgggttcgggttacgggtaccggggtaacggtaaacccgtaaccgggtttcggtaaccccgtcccggttaccggttacccggaacccgtaccccggtaacggtcccggttaccccgtaccccccggttacggtttaccccaccgtttcccgttaccccccgg

SEQ ID NO: 175329 - DNA, 658 bp, Homo sapiens
  misc_feature: GYAE6OF01CK7US.25.55.E11.1.454.CMB.1.raw
  modified_base (303)..(303): a, c, t, g, unknown or other
  misc_feature (303)..(303): n is a, c, g, or t
tcagactgtacagtcacgaccggtgctcgatttagcactcgcacgttgggtttgggggggtctcaggaggcagcgctctcgggacgtctccaccatggcctgggatctgctgttcctcaccctcctcactcagggcacagggtcctgggcccagtctgccctgactcagcctgcctccgtgtctgggactcctggacagtcggtcaccatcctcctgcactggaaccagccgtgacattggtgcttataactatgtctctgtacccaacaacacccaggcaacggccccaaatcatcatttangatgtcagtcactcggcctcgtgtacgttcgtgtctcttctcgtcgtcctacgtactcgcggactacgtcgccctccgtcgacctacgtccggtcgggccctaccgtaggtcgtaggaacgggtacgtaacgtacgtttaacttaagtttacgttcgtaactttacgtttacaacgttaacgaagaccgtaaccaacctaacgttgttcggttacggttacgggtccgggaacgggtaccggtaaccgttaacggttccgttacccggttcccggttacggaccggacccgaacccgtaccggtcccgtccccggtaccccggttaccgtaccttacccgttcgtttaccccccg

SEQ ID NO: 175330 - DNA, 789 bp, Homo sapiens
  misc_feature: GYAE6OF01C9EXO.25.55.E11.1.454.CMB.1.raw
  modified_base (564)..(564): a, c, t, g, unknown or other
  misc_feature (564)..(564): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtatttgtcgacctcctatgtagttcgacccagcctccgtcggtcgtcccgtcttcgtcgggccagacacgccacgccctccctgccttcgtcggtaccgtttaaagggcgggggacaaggtaacgttcgtaggttagttggttaggtaacttcgtaggttacgggaccgggtcccggggtccgttccgtacccgacgttacgtacgtcgtacgtttcgttacaaactgttagacgttacggaccggtcccgtagaggtacctttccggtacggttcccggttttgtaccggtccttaccgtaacggttccggtacgggtacctaccggcctaaccgtcgtacttagtttacgtcgggtacggacctaagggtgtacggtaggtactagggtaacggttcgttacttagttttcgagttaacgnggtacgtgggtaccgggtcgacccgtaccgggtcgtcgggtttccggtcggggggacccgggccctaacccggcggttcccggtacggtaccccgttcgggtcgggtaccacccgggtaccgaccggttcccgaccccgtcccccggtacggttaccctcccgttcccgtttacccgtaccccccgttacccctccttacccgtaaccgtcgtacccgttaccgg

SEQ ID NO: 175331 - DNA, 586 bp, Homo sapiens
  misc_feature: GYAE6OF01AZ17M.25.55.E11.1.454.CMB.1.raw
  modified_base (336)..(336): a, c, t, g, unknown or other
  misc_feature (336)..(336): n is a, c, g, or t
  modified_base (503)..(503): a, c, t, g, unknown or other
  misc_feature (503)..(503): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggcctcagggattcctgaccggttttcnggctccaagtctgggactacggccactctcatttatcgtggacccaggatgtggatgaaggtgtcttatttctgtcagtcgtggtcgggaccggtccgtaccgtcggtcggtcgttccgggccgggggtccacccgacgtccgtacggaccgttcccggtgggtccncggcccgaaggcccgtccggcccccgtggtccctacgtccctccgttcccctaccccgtccctacccgtactcgtactaccgg

SEQ ID NO: 175332 - DNA, 862 bp, Homo sapiens
  misc_feature: GYAE6OF01EH886.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttcgacccagcctccgtcggtcgtccgtctcgtcgggccagacacgccacgccctcccctgcctcgtcggtaccgtttaaaagggtcgggggactaaggtaacgttcgttaggttaattgggtttagggttaacttcggtaaggtttgggaccggggtcccggggtcccggttccgtacccggtacttcgtaacggtcctaagtttcgtttaccaaacgtagttacggtaacgtacggacccggtaccctacggtaacgggttacctttcccgttacgggtttacccgggtttttccgcgggtaccttaccgtaaggttccggtacggggtaacccgttaaccggcctaacttcctacgtaacttttacggtccgggtacggaacccgtagggtacgttgggtacggtaagttaggtaacgggttcgttactttagtttcgtacggttccgtaaggtcggtgggtacggggaccggtaccgttacccgggtcgggtacccggggttcggttcccgggggccgggggtaccctacccggtcgggtccgttacccgggtacccgttccgggtacgggtacccgacggtaccccggtacggtcccgtaccccggtcccccgtacggttaccctacccggttcccgttaccccggttaccccctaccccgttaccgtacccgtaaccgttcgtaacccgttaccgg

SEQ ID NO: 175333 - DNA, 558 bp, Homo sapiens
  misc_feature: GYAE6OF01A0LX2.25.55.E11.1.454.CMB.1.raw
  modified_base (302)..(302): a, c, t, g, unknown or other
  misc_feature (302)..(302): n is a, c, g, or t
  modified_base (504)..(504): a, c, t, g, unknown or other
  misc_feature (504)..(504): n is a, c, g, or t
  modified_base (526)..(526): a, c, t, g, unknown or other
  misc_feature (526)..(526): n is a, c, g, or t
  modified_base (549)..(549): a, c, t, g, unknown or other
  misc_feature (549)..(549): n is a, c, g, or t
tcagactgtacagtcacgaccggtgctcgatttagcactcgcacgttgggttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagccctcccctgcctctggccttaaaggtggggcagaagtctgtatgttggtatcgagttgaggccgggccggtctccgactctagtcatcttcaacntgatacgacggccctcgagggacttccctgtacccggtttttctcggtctccaaacggtctcggggactacggccactcgtctattacttcgtcgggacccaggactggtggatgaaggttgtcttatttctgtcagctggtgggaccgcacccggtcgcggttcgtcgggcggggccacccgagcgtcgaccgtcgtcggncgccgagctcgccccgtgtccncctctccgtcccgtccctcctcnctcgtctcg

SEQ ID NO: 175334 - DNA, 592 bp, Homo sapiens
  misc_feature: GYAE6OF01CCO1I.25.55.E11.1.454.CMB.1.raw
  modified_base (576)..(576): a, c, t, g, unknown or other
  misc_feature (576)..(576): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgcctctggccttaaagtgggcagaagtctgtatgttggtatcagttgaggccggccggtctccgactctagtcatgtttcaactatgataggacggccctgagggtattccgtgtaccggttttcgaggtcctaccgtaagtctagggacctacggccacttctctatttacgttcgtagggacccaggtacttggtaggataggtaaggttgtacttatttcgtgtcagtcgtggtggacggcaccgtcgcggtcgtcgggcggggccacccgagtcgtcgaccgtcgtggtccagcccgaaggtcctccgtcccccgtggtcctaccgttccgtccgttacccccgcccttccctaccnccgttcgtcgtaccgg

SEQ ID NO: 175335 - DNA, 677 bp, Homo sapiens
  misc_feature: GYAE6OF01CE2D2.25.55.E11.1.454.CMB.1.raw
  modified_base (231)..(231): a, c, t, g, unknown or other
  misc_feature (231)..(231): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagngggcagaagtctgtatgttgtatcagttgaggccggcgtctcgactctagtcatgttcaacatgatagacggccctcagggattcccgtgtacccggttttctggtctccaagtctggggactacggcctaactctactatttacttcggtgggaccccaagggatggtggaagtggaagggttgtaccgttaattttcgtgtctaaggtccgtggttacgggggaccggacctacccgggttcggcccgggtttccgtttaccggggcccgggggggacccaaccccggtaacggccgttcgggaaccccggttccggtacggggtccaacggccccgaaaaggtccccgttccggccccccgttccggtccgaaccctttcccgttacccggtttaccccctaccccgttacccctaccgtacccttaggttaacccgtaccgg

SEQ ID NO: 175336 - DNA, 542 bp, Homo sapiens
  misc_feature: GYAE6OF01A7KJU.25.55.E11.1.454.CMB.1.raw
  modified_base (331)..(331): a, c, t, g, unknown or other
  misc_feature (331)..(331): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (473)..(473): a, c, t, g, unknown or other
  misc_feature (473)..(473): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctccctgctctggccttaaagtgggcagagtctgtatgttgtatcagttgaggccggccgtctccgactctagtcatgtttcaacatgatagacggccctgagggattcctgtacggttttcnggtctccaagtctcgggactacggcactcgcattatcgngggacccnggtatgtggtatgaaggtntcttatttctggtcagtcgtgtgggtacgcgtacgtcgtcggtccgttcgggacgggcaccgagctacggctccgngtcaggcccaaggcctcggcccctggcctacncttccgtccccnccttacccgtcncttcgtcgtaccg

SEQ ID NO: 175337 - DNA, 779 bp, Homo sapiens
  misc_feature: GYAE6OF01B2AA9.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtatttgtgacctcctatgagttcgaccagcctccgtcggtgtccgtctcgtcggccagacagccacgcctccctgctcgtggaccttaaaggtgggcagagtctgtagtgttggtatcgagttggacgggccgggtccgtctccgactctagtctattcgtttacaacgtatgactacggaccggtcctacgacgggtacttccggttggttacccggttttcgacgggtccttaccgtaaacggttccggtacggggtaacccgtaccggtaccctaacttccgttacgttaacgttttaaccggtttcgggtaaccggggtaaccccgttaggggtacgttacgggttagggtaaggttagggtaacgggtttcggtttaccgtttagttttccgttggtaccgtaggtcgggtgggttacgggacccgggtcccggtaccggtccgggttccgggttccgggttccggggccggggtacccgacccgacgggtcccgtaccggtacccggttccggtccgggtaccaccgggaccccgtaacgggtccccgtacccggtcccccgtacgggtccctacccggtcccgttccccggttccccgtccccttcccgtaccgaccgttcgtccgtacgg

SEQ ID NO: 175338 - DNA, 816 bp, Homo sapiens
  misc_feature: GYAE6OF01CEYW4.25.55.E11.1.454.CMB.1.raw
  modified_base (651)..(651): a, c, t, g, unknown or other
  misc_feature (651)..(651): n is a, c, g, or t
  modified_base (750)..(750): a, c, t, g, unknown or other
  misc_feature (750)..(750): n is a, c, g, or t
tcagactgtacagtcacgaccggtgctcgatttagcactcgcacggttggggtttggggctgggcctcaggaagcagcatcgggaggtgcctcagccatggcatggatccctctcttcctcggcgtccttgcttactgcacaggtatttgtgaccttcctatgagttcgacccagccctccggtcggtcgtccgtctcgttcgggccagacacgccacgccctcccctgctcgtcggaccttaaaggcggggacagtaagttctagtattggttggtatcgtaggttcggacgggccgggtccggtcctccgactcgtacgtctattcgtttacaactagtgagtacgaccggtccctacgagggttacttcccgtaggttacccggttttctcggtcctaccgtaaggttccgtacggggtacctacccggtcctaacgttccttacgttaagtttacccgtttacgggaccgggtacccgtagggttaagttcgggttaggtacgttaggtaaacgggtttcgttacgttttaacgttttcgtaggttaccgacgggttccggtttaggggttacgggacccggaccgttacccgggtcgggtacccgggtttccgggttccggggggaccggggccctaaccccgggnggttaccggttaccgggtaccccgggttacggtcgggtacccgtaacccggtaccccggtacggtacccgtccccgggtacccccgttcgggtaccccncgtttacccgttaccccgtttccccccgacccttaccccgttagtaacccgttcgtaccgttcggg

SEQ ID NO: 175339 - DNA, 781 bp, Homo sapiens
  misc_feature: GYAE6OF01CDB22.25.55.E11.1.454.CMB.1.raw
  modified_base (200)..(200): a, c, t, g, unknown or other
  misc_feature (200)..(200): n is a, c, g, or t
tcagactgtacagtcacgaccggtgctcgatttagcactcgcacgttgggtttggggggggtctcaggaggcagcgctctcgggacgtctccaccatggcctgggctctgctgttcctcaccctcctcactcagggcacagggtcctgggcccagtctcgccctgactcagcctgcctcgtgtctgggactccgtggacngtcggtcaccatctcctgcacgtaggaaccagccgtagactagttggtactacttaataactatgtcctcctcggtaccccaaaccgaaccaccgacggaccaaaccggacccccaaacgtcactactatttatgattcgtacacgtacctacgtcccgtacccttcggtggttacgtttcggttcggttccgttcgtttccttccggttacggtaccttaccgttaaacgttccgtacggtaccctaaccgtcccggtcccttcccgtaccggtaacctacgttacccgggtcccggggtacctcccggtacggtacggtacggtaacggacgggtaacggttcttaacgtttatttaacgttcgtacttactttaaccgtaagtaacgaacggaactaaaccctaaccgaaacgttagttcccggttaggggttcggttaccggggtaaccgggaccgggtaaaccgttacgggttacccgtacccggtttccggacccgggttcgaaccccgtacccgggtaacgcccggttccccggaccccgttcgtacccccgtacgttcccgtttaccccccgg

SEQ ID NO: 175340 - DNA, 597 bp, Homo sapiens
  misc_feature: GYAE6OF01BH37Z.25.55.E11.1.454.CMB.1.raw
  modified_base (181)..(181): a, c, t, g, unknown or other
  misc_feature (181)..(181): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (470)..(470): a, c, t, g, unknown or other
  misc_feature (470)..(470): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttcgacccagcctcgtcggtntccgtctcttcggccagacagccagccctccctgctctggccttaaagtgggacagaagtctgtatgtgtatcgagttgacggccggcgtctcgctctagtcatgttcaagatgatacgacgcctgaggtcttccgtgtaccgtttngcctacagttctgggactcgccacgtctactatttcgtcgtcgggaccnggtactgtggacgtagtagttntacttattcgtgctagtcgttaggcgggacgcgtaccgttggtcggttaccgtcgggacgggccaacccgnggtccctacggtcccgtcgtacgggtcccaaccggtcccacgggtcccttcccggccccgttaggtaccctccgttacccgttcccgtccccctaccccttccggaccttacgtccgtaaccgtcgg

SEQ ID NO: 175341 - DNA, 782 bp, Homo sapiens
  misc_feature: GYAE6OF01DOOCP.25.55.E11.1.454.CMB.1.raw
tcagactgtacagtcacgaccggtgctcgatttagcactcgcacgttgggttggggctgggcctcaggaagcagcatcggaggtgcctcagccatggcatggactccctctcttcctcggcgtccttgcttactgcacaggtatttgtgaccttcctatgtagttcgaccctacgcccgttccggtcggtcgtccgtctcgttcgggccagacacgccacgccctccctgtcctcgtcggtaaccgttaaaggtcggggactaaggtaagtcttaggttattggttaggtatcggtagtgggaccgggtccgggtccgttcctccgtaccttgtacggtcttagttcgtttacaaactgttacggactaccggtccgtccgtacggaagggttacctttcccggtcggtttaccggttcgtccggtacctaccggtaagtcccggtaggtaccgaccggtacctacttctacgtatttacgtcgggtcgaccgaggtagtcggtaggtagtaggtaacgttcgttccgtttagtttcgtacgtacgtacggtccggtagggtcgggtaccgcccgtacgggtcggtccggtcgggtacccgggccgggggaccctacccgggcggtccggtccggtacccggtcccggtcggtacccgtacccggtacccggtacccggtcccgtacccggtcccccggtacgttacccgtaccgttcccggttccccgttcccccgtcccgttaccccgtacccgttaaccgttcggttaacccgtcgggg

SEQ ID NO: 175342 - DNA, 693 bp, Homo sapiens
  misc_feature: GYAE6OF01CL5XM.25.55.E11.1.454.CMB.1.raw
  modified_base (257)..(257): a, c, t, g, unknown or other
  misc_feature (257)..(257): n is a, c, g, or t
tcagactgtacagtcacgaccggtgctcgatttagcactcgcacgttgggtttggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccagccgtgaccatttggtgctttaataaactnttcgtctccgtcggtacccaaactaaccacccgaggaccaacggacccccaaactcactcgtaactttatgtatgtacagtactacgtcccgggtccccttgttacgggtacgttttcgtcggttccgttctttccgttaccgttcgggtacccttaccgtaaggttcccgtagggaccctaaacccgttccgggtaccccttccccgttacgtaccctacgttcccggtacccggggtctaccggacgtccgtaggtacgggacggtacggtacttacttagttacgttgtacttacttacaacttaacacgtaacgaccaaccctaagtacgtcttaggttcggtcggacggacggtaccgaagttccggaccgttccgcggtaacgcgacccgtaagtcccgtaccgtaccccgtgtccctcgtccttccccg

SEQ ID NO: 175343 - DNA, 719 bp, Homo sapiens
  misc_feature: GYAE6OF01EOZOI.25.55.E11.1.454.CMB.1.raw
  modified_base (322)..(322): a, c, t, g, unknown or other
  misc_feature (322)..(322): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtatttgtcgaccttcctatgagttcgacccagcctccgtcggtgtccgtctcgttcgggccagacacgccagccctccctgctcgtggaccttaaaggtggggacagtaagtcgtgtatggttaggtatcaggttggacgggccgggccggtcctccgactcgtagtcattgttacaactntagatacggaccggtccctcgagggtacttcctggtaccggtttttcgtcggtacctccgtaacgttcggtacgggtaccgtaccggcctactcctactaactttacgttcggtaccggggtacccgtaggtagttcggtaggacgttaggtaaggttcgtttacttagtttcgtcgtcgtagtcgttagggtcgggaccgtccgtaccgggtccgggtccgggtttccgtcggggggccggggtaccacccggacgtccgtccggtacccggttccgtacgggtaccgaccggacccggtacggtccctccccggtcccccgttgggaccctcccgttccgtttccccggttaccccctaccccgttaccctaccgtaccgttcggtccttacggg

SEQ ID NO: 175344 - DNA, 678 bp, Homo sapiens
  misc_feature: GYAE6OF01B4M7I.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctcgtcggtgtccgtctcttcgggccagacagccagcctcccctgcctctggaccttaaaggtggggcagaagtctgtatgttggtatcagttgaggccgggccgtctccgactctagtcatgtttcaacatgatacggaccggccctacgagggtacttccgtcggtacccggttttctcggtcctccgaagtcgtgggacctaccggcctactctctatttacgttcggtcgggaccctagggtactggtaggtagtacggtaagggttcgttcgtttaagttttcgtacgttcgtaggtcgttgggtcggggaccggccgtacccggtcggtccgggttccgttccggggcgggggccacccggcggtccgtcggacccggtcggtcgggtctaccggcccggaacgggtcccgtcccggtccccccgttcgggtaccctcccgttcccgtcccgttccccctacccccgttcccttacccgtaccgttcggtacccgttaccgg

SEQ ID NO: 175345 - DNA, 742 bp, Homo sapiens
  misc_feature: GYAE6OF01DOSVB.25.55.E11.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (450)..(450): a, c, t, g, unknown or other
  misc_feature (450)..(450): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctctcgggccagacagccagcctccctgctctgccttaaagngggcagatctgtatgtgtatcagttgaggccggccggtcnccgactctagtctattgtttcaactatgactacggaccggtccctgagggtactttccgtaggttacccgtttctcgggtcctacgtaagttccgtacgggtaaccgtacggtccctaacgtcctacttagttacgttcggtacgggacccgtaggtagtcggtaggagtaggtaacggttntacttagtttcgtacgttacgacgtccgtgggtaccgggaaccgggtcctacccgggttcggtccgggtttcggttaccgggggcccggggcctaaccccggtggtcccgttacggggtaaccccgttcccgggttaggggtaccccaccggggtaacccccgaagggttcccccgaccccgggtttacccccccggttcggggtaacccttaccccgtttccccgttcccggttacccccccttaacccccggtttcccttaccgtaacccgtcgttaacccgttaccggg

SEQ ID NO: 175346 - DNA, 797 bp, Homo sapiens
  misc_feature: GYAE6OF01EKWSH.25.55.E11.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
tcagactgtacagtcacgaccggtgctcgatttagcactcgcacgttggggtttggggggggtctcaggaggcagcgctctcgggacgtctccaccatggcctgggctctgctgttcctcaccctctcactcagggcacgtagggtcctgggcccagtctcgccctgactcagcctgcctcgtgtcgtggactcgtggacngtcgcaccntctctgcacgtacgaaccngcgtagactagttggactactttaactactntcgtcctccgtacgtacccaaacaaccaccgacgtaccaaccggaccccaaactctaagtctaagtttctagtatcgtactagtcacgtccgcctcgtcggtactttcgtcgtctctttcgtctcggtacctactagtacgtcgtactaccgtcgtcccgttacccgacgtaccttcgtacccggtcgggtcctacggtacggtacgtacggaacgggtaacggtacgttactttaacgtttactttacgtagttaccgtttaacttacaacgtacgaacggtaaccgtaaaaccttaacccggtacgttaacggttaccgggtttacgggttttaaccgggggtacggggtaaccgggttaaccggggtaaaccgggtttaaccgggtttaacccgggttaccccggttacccggggttaacctaccccgggtaaccggtaacccccggggttaaccggaccccggttttccccccggttaaccccggttaccgggtttaccccttaaaccggtttccccggtttaaacccccccg

SEQ ID NO: 175347 - DNA, 833 bp, Homo sapiens
  misc_feature: GYAE6OF01DTYO8.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggctccttgcttactgcacgaggtatttgcgacccttcctaagtgtaagttcgaccctagcctccggtcggtcgtccgtctcgttcgggaccagacagccacgccctcccctgcctcgtcggtaaccttaaagggtgggacagtaacgtctaggttatggttagtatcgtaggttcggacgggtcccgggtaccggttcctaccgtacgttacgtaacggtacctagtttacgtttaacaactagttacgaacgtaccggaccggtacccgtacggtaaggtacctttccgtcggttaccgttttcgacgggtacctaacggtacgttaccgtaggggtacccctaacggtacctacgttactacgtagtttaaccgttccgggtacggtaacccgtaggtacgttaggtacggtagtaacgggtaacgtttacgttactttacgtttacgtcgttacgtaggtcggttacggggtagggacccggtaccggttacccggtacgggtccgggtttccgggtaccgggggcccggggtaaccccgtaaccggtaccggtaccggttcccggaacccgggtttccgggtacgggtacccgaaaccgggtccccggtaaaccgggtcccgtaacccgtcccccgggttacgttaccctacccggtttcccgtcccgttccccgtacccgttcctacccgtacttccgtaccgtaccgg

SEQ ID NO: 175348 - DNA, 981 bp, Homo sapiens
  misc_feature: GYAE6OF01EWH70.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccatctcctgcactggaaccagccgtgaccatttgggtgctttaataaaccttagtcgtccttccgtacggtaccccaaaacaaaccgaccccgaaggacccaaacgggaccccccctaaaaacttccgaacttaccgtaactttttaaacgtcggtaaacgttcggttaccgtaacggttcctaacgttcccgggtaccccctttacggtttacgggttaacggttttttccgttacgggttcccgttaccgttttccgttaccgttcgggtcccgttaacccgtaaacggttcccgttacggggacccttaaacccggttccggggtaccccctttccccggtacggtaaccccgttacgttcccggtcccggggggtacccttaccccggtaacgggtccgttacgggacgggtaaccggtacggggttaccctttaaccgtttaagtttacgtttacgttacgtttacctttttaaccgaacgtttaaccgaacggttaaccggaaacccttaaaccccgaaacggttaaccggtttaccgggttaggggttttacccgggtttacccggggggtaacggggttaaacccggggtaaacccggtttaaaacgggtttcccgggtaaaccccccgggttttacccggtttacccggggttaacccgtaaacccgggccccccgggttaaaaccggggtccccgtttaccccgggtaccccccccgtttaccggggtaacccccttacccgggtttcccgttttaacccccccgg

SEQ ID NO: 175349 - DNA, 886 bp, Homo sapiens
  misc_feature: GYAE6OF01ATW95.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctctatgagttgacccagcctccgtcggtgtccgtctcgtcgggccagacagccacgccctcccctgctcgtggaccttaaaggtcgggacagaacgttcgtgtattggttggtatcgtaggttcggacgggccgggtccggtctccgactctagtctattcgtttacaactagtagagtacggaccgtcccgtacggaacgggtacctttcccgttacgggttacccggtttttcgacgggtacccttaccgtaaacggttccggttacggggaacccttaacccgggccctaaccgttccgttacgtaacgttttaaccgtttaccgggttacggggaacccctaagggtaagttcgggtaggtacggtaggtaacgggtttcgtttaactttacgttttcgtacggtttacgtaacggtcgggtttacggggtaccggggacccgggtacccggtaacccgggttccgggttaccggggttttcccgggtttccggggggaccccggggggtaccctaacccccgggttacgggacccggtttacccgggttaaccccggttcccgggttaccggggttacccgaacccgggtaccccgggtaaacgggtcccccgttacccgggtccccccgttaccggggttacccctaccccgttttcccggttaccccggtttcccccccgtccccgttcccgttaccgtaaccccgtttcgtaacccggttacccggg

SEQ ID NO: 175350 - DNA, 699 bp, Homo sapiens
  misc_feature: GYAE6OF01D95JX.25.55.E11.1.454.CMB.1.raw
  modified_base (606)..(606): a, c, t, g, unknown or other
  misc_feature (606)..(606): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtatttgtcgaccttcctattgagttcgacccacgcctccgtcggtcgtccgtctcgttcggccagacacgccacgccctccctgcctcgtggtaccttaaggtcgggcagagtctgtagtgttgtatcgtagtggacggccgggccgtctccgactctagtctagttcgttacaacgtgtaggatacggaccggtcctagacgggttacttccgtaggttacccgttttcgcgtcctacgtacgttcgtcggacccgtacgcctacttctactacgttcgttaccgggtacggacccgtaggttcgtaggtcggtaagtacggtaagttcgttacttacgtttctacggtcgtacggttcgtcggttacggggaccgtccggtaccggtccggttcgggttccgggtccggggaccgggggtaccacccggtaggtcccgtcggtacccggtaccgttcgggacnccgtaccgacggtcccgtcccgccccggttaccgccttccgtcccgtttcccgtacccccggtcccttcccggtccctacgtcgcccgtacgg

SEQ ID NO: 175351 - DNA, 634 bp, Homo sapiens
  misc_feature: GYAE6OF01BW5R8.25.55.E11.1.454.CMB.1.raw
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
  modified_base (508)..(508): a, c, t, g, unknown or other
  misc_feature (508)..(508): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgccttactgcacaggatttgtgacctcctatgagttgacccagcctccgtcggtgtccgtctcttcgggccagacagccagccctcccctgctctggccttaaaggtggggcagaagtctgtatgttggtatcgagttggacggccgggccggtctccgactctagtctattgtttacaacatgaagtacggaccggccctcgagggtattccctgggtacccggttttctcggctaccgaacgttcgtacggactacggcctacgtcctnatttacgtcggtcggacccaggngtgtggagtggaaggttntacttattcgtgtcagtcgtggtagggccgtcgaccggtcgtcggttccgttacggggccggggtaccncccggtagtccgtacggtaccgtccggtcggtcaccggcccgtacggcccgtcccgcccccgtcggtaccctaccgttcctcccgttaccccctaccccttcctacctacgttcgtaaccgtacgg

SEQ ID NO: 175352 - DNA, 767 bp, Homo sapiens
  misc_feature: GYAE6OF01DTNVZ.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtatttgtcgacctcctatgagttcgacccagtccctccgtcggtcgtccgtctcgttcgggccagacacgccagccctccctgctcctggtaccttaaaggcggggctagaacgttctgttatgttggtatcgtaggttcgacgggtccggtccgtctaccgtactcgtagtctatttgttaccaactagtcgaagtacggacccggtccctacggtacgggtacctttcccgtacgggttcccggttttgtcggtcctaccgtaacgtccggtacgggaacctaccggccctagttcctacgttaatttacgtttccgggacggtacccgaggtacgttggtacggattgggaacgtttgtactttagtttcgcgtacgtacgtcgttagggtccgggaccggtcgtacccggttcggtacggttccgggttacgggggacccgggtcctaacccggtcggtcgtacccgggttacccggccggttcgggttacccgaccgggacccgttaacgggccccgttacccggtccccccgggttagttcccgtaccccgttccggttacccccgttccccccggtaccctttacccggtaccctttaccggtaccgttcccgtacggg

SEQ ID NO: 175353 - DNA, 688 bp, Homo sapiens
  misc_feature: GYAE6OF01BHLQ9.25.55.E11.1.454.CMB.1.raw
  modified_base (170)..(170): a, c, t, g, unknown or other
  misc_feature (170)..(170): n is a, c, g, or t
  modified_base (228)..(228): a, c, t, g, unknown or other
  misc_feature (228)..(228): n is a, c, g, or t
  modified_base (260)..(260): a, c, t, g, unknown or other
  misc_feature (260)..(260): n is a, c, g, or t
  modified_base (324)..(324): a, c, t, g, unknown or other
  misc_feature (324)..(324): n is a, c, g, or t
tcagactgtacagtcacgaccggtgctcgatttagcactcgcacgttgggtttggggggggtctcaggaggcagcgctctcgggacgtctccaccatggcctgggctctgctgttcctcaccctcctcactcagggcacgagggtcctgggcccagtctgccctgactcngcctgcctccgtgtctgggactcgtgacagtcgtcactatcgtctgcactcggaaccncgccgtgacgtattggagttacttaataactntctcttccgtacgtaccaacaccgaccagaccaaccgtacccccaaatctactacttattttanagtaattcgtactaacggtctaacgttcccggtacccttggtacggttacgttttccggtcggttccgtctttaccgttcgtacggtaccctacgtaacgttcgtacggaacctaccggtcccgtcccctaccgtacgtaccttacgtcgccgggtctccggagtcgtacggacggtacgtacgttaccttacgttattacgttctacttacttcgttaacactacgtaacaccaacctataggttcgtcggttgtacggacggtacgtaccgttagtaccggtaccgtccggtacgtaccggaccgtaccgaaccggtcctacccgggtccctaacccggttctcccgtttcccgtaccccgg

SEQ ID NO: 175354 - DNA, 724 bp, Homo sapiens
  misc_feature: GYAE6OF01A9S5E.25.55.E11.1.454.CMB.1.raw
  modified_base (240)..(240): a, c, t, g, unknown or other
  misc_feature (240)..(240): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctcgtcggtcgtccgtctcttcgggccagacagccacgccctcccctgccttctcggtaccttaaagggnggggacagaagtctagtattgttggtatcgaggttgacgggtccgggccggtctccgacttctaggtctattgtttccaacgtatcggatacggaccggtcccgttcgagggttactttccgtcggttaccggtttttcgcggtccttccgaacggttcggtacgggtacgtacccggcctacttctactatttacgtccggtacgggaccctaggtacgtggtacggagttaggtaaggttcgttcttagtttcgtaggttacacggtcgttagggtacggggaccgtaccggtaccggttccggccgggtttccgggttaccgggggccggggtacccaccccggtgtccggtaccggttaccggttcccggtcggtaccgacccggtccgtaacgggtcccttcccggtcccccgtcggtactcccgttcccgttacccgttccccgtaccccttccgtaccgtaccgttcgtacgtacgg

SEQ ID NO: 175355 - DNA, 704 bp, Homo sapiens
  misc_feature: GYAE6OF01DYQS9.25.55.E11.1.454.CMB.1.raw
  modified_base (367)..(367): a, c, t, g, unknown or other
  misc_feature (367)..(367): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtattttgtcgacctcctagtgagttgacccagcctccgtcggtgtccgtctcgtccgggccagacagccacgccctccctgctctcggtaccttaaaggtgggcagagtctgtatgtgtatcgagttggaggccgggccgtctccgactctagtcctagttgtttacaactagtggactacggaccggccctggtacgggtactttccgtggttacccggttttcnggcctacgtaagtcgtacggactcggcctactctcgtattacgttcggtcggaacctaggtagtggtagtagtaggtaagttgttactttagtttctagttcgtacgtcggttgggtcggggaccggtccggtaccccgggttcggaccggggtttccgggttccgggggcccggggaccctaaccccggtgtcccgtaccgggacccgttccggtccgggtaccacccggacccgtaacgggcccgttcccggtcccccgtacgggttccctaccggttccccgttcccggttacccccgtccccttacccgtaccgtaccgttcgtccggtaccg

SEQ ID NO: 175356 - DNA, 853 bp, Homo sapiens
  misc_feature: GYAE6OF01EH8K0.25.55.E11.1.454.CMB.1.raw
  modified_base (246)..(246): a, c, t, g, unknown or other
  misc_feature (246)..(246): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacgaggtatttgtgacctcctatgagttcgacccagtcctccggtcggtgtccgtctcgttcgggccagacacgccacgccctcccctgtcctcgtggtaccttaaaggnggggacaggtagtctgtagttggttggtatcgaggttggacgggcccgggtccgtcctccgactcgtagtctagtttcgttacaactagtagtacgtacggacccggtccctacggtaacgggtctttccgttacggttaccggttttcgtacggtcctaccgtaggttccgtacgggtaccgtaccggcctacgtacctctagtttacgttcggtcgggaacccgtaggtagttgggtacggtagttacgggtaacgggtttcgtttacgtttacttttcggtacgttacgtacggttcggttacgggtacggggaccggtaccgttaccccgggtcgggttcccggggtttacgggtcccggggggacccgggggtaccccaaccccgggtcgggtacccggttacccgggtaccccggtttacccgggtacggggtaccccgtaaccgggtaaccccggtacgggtcccccggttccccggtacccccccgggtttccgggttaccccttccccgggtttcccccggttcccccggtttaccccccccggtccccgtttacccccgttacccgttaacccgttccgggttaacccgtaccgggg

SEQ ID NO: 175357 - DNA, 919 bp, Homo sapiens
  misc_feature: GYAE6OF01C1PA9.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtcttgcttactgcacaggtatttgtcgaccttcctatggagttcgaccagcccgtccgtcggtgtccgtcttcgttacgggcagacagccacgccctcccctgccttcgtcggtacctttaaagggcggggacaggtaacgttctagttattggtggtacttcgtaggttggacgggtcccgggacccggttctacccgtacgttacgtacggttactaggttttcgttttaaccaaacgttagttacgtaaacggtaccggtaacccggtcccgtacgggtacggggttaacccttttccgggtaccgggtttaccccggtttttcgtcgggtccctaaccgttaggtttaccggtacggggtaaccttacccggccttaaaccctttccgtaaccgttaacgttttccggttaccgggtaccggggtaaaccgtaagggtcgttaggggtaacgtaggtacgggttaaggttccgtttaactttacggttttcgaaacgtttcggaacgggtttccgggttaagggtaccggggtacgaccccgggtttaccgggcccgggtttcccgggggttccgggttaacccggggggcccgggtaacccggtaaacccggcggggtttacccgaccgggggttaccccttccgggggtaccggacccgaccggggttacccccgaagggttccccctccccgggtcccccgttagggtaccccgttcccgttaacccccgtttccgaccccccttccccgttaacccgttcgtaaccccggttacgtcggttaacccggg

SEQ ID NO: 175358 - DNA, 815 bp, Homo sapiens
  misc_feature: GYAE6OF01B9FUM.25.55.E11.1.454.CMB.1.raw
  modified_base (347)..(347): a, c, t, g, unknown or other
  misc_feature (347)..(347): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttcgacccagcctccgtcggtgtccgtctcgttcgggccagacagccagccctcccctgcctcgtggtaccttaaaggtgggacagaagtctgtatgttgtatcgagttgaggccgggccgtctccgactctagtcatgtttcaacatgatacggaccggcctgagggattccgtggtaccgttttncggtctaccagtcgtgggactacggccactctctacttattcggtaggacccgtagggattcgggtaggtagttacggaagggtttcgttacgtttaacgttttcgtaggttaccgtaggtccgtttcggggtacggggaccgggtcccgtaacccgggttccgggtacccggggttttccggttcccggggggcccggggggtaacccctaccccgggtagggttacccgggttaccgggtaacccccgggtttcccggttacgggggtaccctaaccccgggaaccccgggtaaaccgggtccccggttacccccgggtccccccccgggtttcccggggttaccccgtttaaaccccggttccccggtttaccccccggttttcccccccccgggttaccccccgtttacccctttaaccccgttacccgggtttaaccggttacccccggtttaaccccggggg

SEQ ID NO: 175359 - DNA, 650 bp, Homo sapiens
  misc_feature: GYAE6OF01DFYYY.25.55.E11.1.454.CMB.1.raw
  modified_base (490)..(490): a, c, t, g, unknown or other
  misc_feature (490)..(490): n is a, c, g, or t
  modified_base (634)..(634): a, c, t, g, unknown or other
  misc_feature (634)..(634): n is a, c, g, or t
tcagactgtacagtcacgaccggtgctcgatttagcactcgcacgttgggtttgggctgggcctcaggagcagcatcggaggtgcctcagccatggcatggatccctctcttcctcggcgtccttgcttactgcacaggatttgtgacctcctatgagttgacccagcctccgtcggtcgtccgtctcgttcgggccagacagccacgcctcccctgcctcgtgccttaaggtgggcagtaagtctgtactgttgtatcgagttcgaggcccggccgtctccgacgtctagtccagtttgtttaccaactacgtgacttaggaccggtacccctgacggggttactttccgttacggtcccggtttttcacgggccttaccgaaaggttccgtacggggtacctacccgggcctaacgtccgttactagtttacgtcgggttcggaacccaagggtctaggtacggattggtaagtgttacttagtttcngttccagtcgtggtacggccgcgaccggtgccggtacgttcgggccggtacaccgtgacctcggtaccgtccgtagggtccaacgcccgagtccgtccgccccgttgaccctcgtccgttccgtcccccgcccttaccgtaccncgttcgtcgtaccggg

SEQ ID NO: 175360 - DNA, 911 bp, Homo sapiens
  misc_feature: GYAE6OF01AKTL7.25.55.E11.1.454.CMB.1.raw
  modified_base (257)..(257): a, c, t, g, unknown or other
  misc_feature (257)..(257): n is a, c, g, or t
tcagactgtacagtcacgaccggtgctcgatttagcactcgcacgttggggtttgggggctgggcctcaggaagcagcatcggaggtgcctcagccatggcatggactccctctcttcctcggcgtccttgcttactgcacgaggtatttgtcgacctctatgagttcgacccagtccgtccggtcggtcgtccgtctccgttcgggccagacacgccacgtccctccctgccttcgtacggtaccgtttaaagggnggggacctaaggtaacgtcgtttagtgtttagggttacggtacttcggtaggttacgggaccggggtccccggggtcccggttaccggttacccgtaccgtttacgtaacggttccgtagttttacggtttaaccaaaccgtaggttacggtaacgttaaccggggtaccccgggtacccgttaccgggaacggggtttaaccttttccccggtaccggggtttttaaccccgggtttttcgcccgggtcccttaaccggtaacggttccgggtacggggtaaacccgttaccgggacctaccgttctacgttacgtttacggtccgggtacggtacccgtagggacgttgggtcggtaaggtcggttaagggttcgttcgtttacgttcgtaacggtcgtacggttcggttcggtacgggtaccggaccgttcccgggtcgggttccggtccggttaccgggggaccgggttacccaccgtcgggtaccggtacccggttacggaccggttcgggaccgttaacccgggccgggttacccgtcccggtaccccccgggtccccggttacgtaccccttaccgggttcccctttaccccggttccccccgttaacccgtacccgttaccctccgggttaactccgtaacccggg

SEQ ID NO: 175361 - DNA, 689 bp, Homo sapiens
  misc_feature: GYAE6OF01C0GJQ.25.55.E11.1.454.CMB.1.raw
  modified_base (121)..(121): a, c, t, g, unknown or other
  misc_feature (121)..(121): n is a, c, g, or t
  modified_base (123)..(123): a, c, t, g, unknown or other
  misc_feature (123)..(123): n is a, c, g, or t
  modified_base (171)..(171): a, c, t, g, unknown or other
  misc_feature (171)..(171): n is a, c, g, or t
  modified_base (376)..(376): a, c, t, g, unknown or other
  misc_feature (376)..(376): n is a, c, g, or t
  modified_base (636)..(636): a, c, t, g, unknown or other
  misc_feature (636)..(636): n is a, c, g, or t
tcagactgtacagtcacgaccggtgctcgatttagcactcgcacggttggggtttggggggggtctcaggaggcagcgctcgtcgggacgtctccaccatggcctgggctctgctgttccncnccctctcactcgaggcacgagggtcctgggcccagtctgccctgactnagcctgcctcgtggtctgggctcctaggacagttccggacacctatcctcctgactacgttacggaaaccaggccttagactagtttgggatcttaataacgattgtaccgtcctggtacccaacaacacccgagcgtaaaccgccccaaagtcaattcagtttatagactggtacagtcacgtcgtacctgtagtagtttccgnggttactcgttctcgttacggctaccggtaactcgtcggtaacaccgtccgacccgtaccgtcggaaacctgtaccgtcggggccttaccgaggggtaactcgggtaaacggacggttaaacgtcgttttaaacttattaaacgtcggtaactaactttccgaaataccgtaagggaactaacgaaacccgtaacgtacgtcgtcgggtggttaccggacgggaacgtaaccgtaacggtgtaaccccgtcgaaccggtnaccccggtaacgaggtacctccgggacccttacggtactcgtccgttaacccg

SEQ ID NO: 175362 - DNA, 872 bp, Homo sapiens
  misc_feature: GYAE6OF01CCETC.25.55.E11.1.454.CMB.1.raw
  modified_base (611)..(611): a, c, t, g, unknown or other
  misc_feature (611)..(611): n is a, c, g, or t
tcagactgtacagtcacgaccggtgctcgatttagcactcgcacgtttgggtttggggctgggcctcaggaagcagcatcggaggtgcctcagccatggcatggactccctctcttcctcggcgtccttgcttactgcacgtaggtatttgtcgtacccttcctatgtacgttacgaccccgagtcccgtccggttcggtcgtcccgttccttccggttaccgggccaagaccgacgacccgccgtccccttccccgcgttacctcggttaccggttaaccggtttaagggcgggggacctaaggttaacgttcgttagttagttaggttggttactgtaacgggttcgggacccggggtccgggtccgttccgtaccgtacttacgttacgtcgtaatttaccgttactaaacgtacttggaaccgtaacggtccccgtaccggtaggttaaacggtttccttacccggtttcgggttttaacccgttcgtaccggtaccttaaccggtaaggttcggtaaccgggtaccctacggcccttaactcgtacttaaggttaccgttcgggaacccgtacgaggtacgtggtacggtagtaggttaacggttnttacgtttacgttcgtcgtattacggcgtttgggggtaacccggcgttacccggtaccgggttccgggttcggtttcgggggttccggggtaaaccccggggcctacccggtaccggtaccggttacccgggtcccgttacccggggtacgccgaacccgggttacggacccggtcccggtccccggtcccggttaacccggtcttcccccgggtcttacccccggtacccttccccgtactccggtacttccggtagtcg

SEQ ID NO: 175363 - DNA, 834 bp, Homo sapiens
  misc_feature: GYAE6OF01EUZ70.25.55.E11.1.454.CMB.1.raw
  modified_base (203)..(203): a, c, t, g, unknown or other
  misc_feature (203)..(203): n is a, c, g, or t
tcagactgtacagtcacgaccggtgctcgatttagcactcgcacgtttgggtttggggctgggcctcaggaagcagcatcggaggtgcctcagccatggcatggatccctctcttcctcggcgtccttgcttactgcactaggtatttgtgaccctctatgagttcgaccagcctcgtcggtcgtccgtctcgtcggcagacngccgacgccctccctgctcgtacggtaccgttaaggcgggacaaggtaacgttcgttagttacgtttggttacggtacgttcggttaggttcgggaccgggtcccgggtcccggttaccgtaccgtacttacgttacgttactacgtttacgtttaaccgaactagtacggtaacgtaaccggacccggtaccgtacggtaacgggttaccttttcccgggttacggtttacccgttttaccggcggtacccgtaccgtaaggtccggtacgggtaacccgtaccggtacctacgttctacgttacgtttaccgtacgggtaccggaccgtaggtacgttggtaggtaggttaggtacgttcgtttacgttattcgtacgtacgtacggtcggtacgggtacgggtaccgtccgtaccgggtccgggttccggttccggggtcgggacccgggtaccgtacccggtacggtaccggtaccggttaccggttaccggtaccgggtaccggacccggtacccgaaccggtcccgtaccccggttccccggtccggtacccttaccccgttcccgttaccccgttacccccgttacccgttcccgttacccgtacggtttacgtccggttacgg

SEQ ID NO: 175364 - DNA, 853 bp, Homo sapiens
  misc_feature: GYAE6OF01BG68G.25.55.E11.1.454.CMB.1.raw
tcagactgtacagtcacgaccggtgctcgatttagcactcgcacggttgggtttggggctgggcctcaggaagcagcatcggaggtgcctcagccatggcatggatccctctcttcctcggcgtccttgcttactgcacaggatttgtgacctcctatgacgttcgacccagcctccgtcggtgtccgtctcgttcgggccagacagccacgccctcccctgcctcgtacggtaccgtttaaaaggtggggacaaggtaagtcgttgtatggttggtaatcgtaggttggacgggtccgggtcccggtactccggacttcgtaacgtctagttcgtttacaactagtagaagtacggaccggtccctacggacgggtactttcccgttcgggttacccggtttttcgaggtccctaccgtaaggtcggttacgggaccgttaccgggaccctaacgttcctacgtaacgtttacgttccggtacgggaaccccgtaagggtacttaggggttacggaacgttagggtaacggttcgttacgtttaacgtttcgtacgttaccgtaaggttcgttcgggggttaacggggacccgtccggtaccgggttcggtaaccggggtttccgggttccgggggcccggggtacccttaacccgggacggtccggttacccggttacccgggttcccggttacggggaccccgaaccgggtacccggtaaaccgggttccccggtacccggttacccccccgggtttcggttaaccccggcccgtttcccggttaacccccggttttaccccccgccccttttacccgtacccgttacgttacccgttacggtaacccgg

SEQ ID NO: 175365 - DNA, 858 bp, Homo sapiens
  misc_feature: GYAE6OF01CUDUV.25.55.E11.1.454.CMB.1.raw
tcagactgtacagtcacgaccggtgctcgatttagcactcgcacgttgggtttggggggggtctcaggaggcagcgctctcgggacgtctccaccatggcctgggctctgctgttcctcaccctcctcactcgagggcacgacgggtccgtcgggcccagtctcgccctgactcacgcctcgcctcgtgtcgtggactccgtagacgtagtccggtcacactcctctcgcacgtacggaaccgacgccgtagacgtagttcggtactactttaataacttagtcgtccgttcccgtacggtaacccaaaacacctaaccgacggaccgaaacccgaccccaatcctaattactatttatacgtacgtcgtacgacgtcctacgtcccggtaccttcggttacggttcgttttcggtcggttccgttactttcggttccgtacgggtacccttacgtacggtccgtacggtaccccgtaccgttcccggtacccctttaaccgcgttaacccgtggttcccgggccgggttaccgtccgggacggttaccccggtaagggtacccggtaacgggttaaccgttacgttttaactttagttttaacggtaccctttaagttacgtttaaacctaacggttaaacgaaccgtaaacccgtaaaccctaaccggttaaagggtcgtttaaccggggttacgggtaccgggttaaccgggggtaacggaaccggttacgtttaaaccggttcccggtaacccggtttcgacccgggtacgtaacccgggtaacccgtaccgggttcccgaccccccggtttcgttacccggtaaccctttccccgttcccggtttaccccccg

SEQ ID NO: 175366 - DNA, 854 bp, Homo sapiens
  misc_feature: GYAE6OF01C71JE.25.55.E11.1.454.CMB.1.raw
  modified_base (132)..(132): a, c, t, g, unknown or other
  misc_feature (132)..(132): n is a, c, g, or t
  modified_base (142)..(142): a, c, t, g, unknown or other
  misc_feature (142)..(142): n is a, c, g, or t
  modified_base (168)..(168): a, c, t, g, unknown or other
  misc_feature (168)..(168): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtctgcttacngcacgagttnttgctacctcgtgtgtagtccgaccncgtccgttcggtggtcgtccgtcgttcggtccggacgagacgaccgaccnccgtcccctccgngtacttcggtacggttaacgttaaggggcggacaaggttacgttcgtagttagttgggtagtactcggtaggtcggggaccggggtcccggtccgttaccgtacgtacgttacgtacgacttacgtttcgttaaacaacgttggtacgtaacggaccggtaccccggtccgttagggtaaccggtttcctttacccggtaacgggtttttccgtttacgccggtacctaacgttcggttacgggacggttaaaccgccgtaccttacttccgttaacgttaacgtttcggtacggggaacccgtaggtaggtcgtttgggaagtacgtagggttacgtttcgttaactttcgttcgtaagtcggtgtacgggttgggtaccgggaccgccggtaccggtcgggtccgtttccggggaccgggaaccgtacccgtacccgtacgggttccgaacccgggttaccggttttcggggcggtaacccgaccggtaccggaccggttcccggacccccccggtttcccggtaacgttaccccttacccgggtttccccgtttccccccgtaaacccccgtttccccgtaacccgtttacggtaccccggttaggttaccccgtacggg

SEQ ID NO: 175367 - DNA, 750 bp, Homo sapiens
  misc_feature: GYAE6OF01DGTYT.25.55.E11.1.454.CMB.1.raw
  modified_base (117)..(117): a, c, t, g, unknown or other
  misc_feature (117)..(117): n is a, c, g, or t
tcagactgtacagtcacgaccggtgctcgatttagcactcgcacgttgggtttggggctgggcctcaggaagcagcatcggaggtgcctcagccatggcatggatccctctcttccncggcgtccttgccttactgcacaggatttgtgacctcctatgaagttgacccagtcctccggtcggtcgtccgtctcgtcgggccagacagccacgccctcccctgacctctcggaccttaaaggcggggacagaagtctgtattggtggtatcgtagttcggacggcccgggtcgtcctacgtactcgtagtctattcggttacaactatgatacggacccggccctaggagggtacctttccgaggtacccggtttcaggtcctaccgtagtccggtacgggaacctaccggcctacgtctacgtaagtttaccgtcgggcggaacctagggaacttgggtacggtagttgggtaacgggtttcttacttacgtttcgtagtccgagttcggtacgggttaacggggccgtaccggtacccgttcgggtccgggttccgggttaccgggggcccggggttacccaacccggtggtcccggtacgggtaccccgttgggtaccgggtccgaaaccccggaccccggtaggtccccggtccccggtaccccccggtggttaacccgtcccgtttccgtccccggttaccccccgtacccgttccctaaccgtaccggtccgttacggtacccg

SEQ ID NO: 175368 - DNA, 714 bp, Homo sapiens
  misc_feature: GYAE6OF01B9N91.25.55.E11.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (478)..(478): a, c, t, g, unknown or other
  misc_feature (478)..(478): n is a, c, g, or t
  modified_base (539)..(539): a, c, t, g, unknown or other
  misc_feature (539)..(539): n is a, c, g, or t
  modified_base (602)..(602): a, c, t, g, unknown or other
  misc_feature (602)..(602): n is a, c, g, or t
tcagactgtacagtcacgaccggtgctcgatttagcactcgcacggttgggtttggggctgggcctcgaggaacgcgagcagtcgggaggtcgcctacgacgtccagtggctagtcggactccctctccttccgcggcgtccttgtactctncagaggtatttcgctacctcgtatgacttccgaccgtcgtccctcggtcgtcgtccnctcgtccggcngacnctcncgtcctcncgcctgtcgtaacggttaggcggnaagtgtgttagtacgttgtagtctcgtaggtccggacgggcccggtcgtcnccgtattcgtacggtnttacggtttacaccaagtagttcgaacgacgtacccggacggtacgtacggtttctaccgtttgggttaaccccgtttgaccggtattacccggtaagttccgggaacgtttcccgcttaccgacggttctaacgtttacgtttacccggngggtaaccggtaggcttaaggttgaggtaacggtggttaaccgtttgtactttagttccgngttaacgcggttacgcgggtacggtaccgccgtacggcgggtttcgacgggtacggccgtacncgtacggctaccggacgtcggcgttaccgacgtccgacggtccctacccggtcgtcctcttcccgtcccgttaccgtccctcccggtaactccgaacggttccgccggttag

SEQ ID NO: 175369 - DNA, 811 bp, Homo sapiens
  misc_feature: GYAE6OF01D5U20.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggattttgtgaccttcctatgagttcgacccagccctccgtcggtcgtccgtctcgttccgggccagacacgcccacgccccttccccgtgtaccttccgtacgggtaccctttaaaagggtgggggaccaggtaaacgttcttggttattggttacggtaatcgtaaggtttcggacggggcccgggtccgggttcctccggacttcgttagtctagtttcgtttacaactagtaggatacggaccggtccctaggacggtacttccgtcgttaccggttttacgcgtcctaccgtaagttccggtacgggtaacctaccggcctaaccttctacttaacgtttacgtccgggtacggaacccgtagggtacgttgggttacggtagttacgggtaaggttcgttacgtttacgttttcgtggttacgtagttccggttgggtaacggggccgtaccgttacccggttcgggttaccccggtttcgggttccgggggacccggggtacctaaaccccggcggtaccgttaacccgggttcccggttccggttacgggtcccgaccggtaacccggtaccggtccgtccccggtccccgttcggtaccctacccgttcttacccggtacccccctacccgttacccgtacgtacccgttgtaccgttccggg

SEQ ID NO: 175370 - DNA, 793 bp, Homo sapiens
  misc_feature: GYAE6OF01BZKFH.25.55.E11.1.454.CMB.1.raw
  modified_base (134)..(134): a, c, t, g, unknown or other
  misc_feature (134)..(134): n is a, c, g, or t
  modified_base (589)..(589): a, c, t, g, unknown or other
  misc_feature (589)..(589): n is a, c, g, or t
  modified_base (779)..(779): a, c, t, g, unknown or other
  misc_feature (779)..(779): n is a, c, g, or t
tcagactgtacagtcacgaccggtgctcgatttagcactcgcacgttgggtttggggctgggcctcaggaagcagcatcggaggtgcctcagccatggcatggatccctctcttccgtcgcgtccttgcttacngcactaggtatttgtcgacctcctaagtgtaagttcgacccgacgtccctccggtcggtcgttcccgtccgttacgttccggggaccaggaccacgccctacgcccctcccctgcctcgtcgggtaacccgttaaaagggttcgggggacaaggtaaaacgttcggttaggttaacgtttgggttttacggtaaccgttaacggtaagggttttacgggaccgggggtaccccgggggttacccggggtttccctacccggtaaacccttcgttaacgtaccgttaagtttacggtttaaccaaaacctcgttaagtaaccttaacgggaccccggtacctacggtaacgggtacctttaccgtcggtttaacccggttttcaccggtcttacccggaagttcgtacgggacctaacggtccacgtactccaagtttactcggtacggaccgtanagtgtagagtagtagtgtacttagttcttagccaggtactgggtacggccgggtaccacgggtccgtcgggtaccggtcggggaccgggtaccgtacccagtcgtacccggtaccgtacggtcgtacgccgaccgttaggccctaccggcccgtacgcctacctcgttaacccgttcccaaccctcctanccgttgtctaccgg

SEQ ID NO: 175371 - DNA, 719 bp, Homo sapiens
  misc_feature: GYAE6OF01D0NQP.25.55.E11.1.454.CMB.1.raw
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
  modified_base (601)..(601): a, c, t, g, unknown or other
  misc_feature (601)..(601): n is a, c, g, or t
tcagactgtacagtcacgaccggtgctcgatttagcactcgcacgttgggtttggggggggtcctcgaggaggcagcgctcgtcgggacgtcgtccaccatggcctgggctctgctgttcctcaccctcctcgactcgacgggcacgtacgggtcctgggcccctaggtcctcggccccttgacctccgacgtcctcggcccttcgtgtccgtgggtcctccgtggaactcggtccgactccacctacttttccnggcctacgttcgacctcaacgctacgttaggtnttggttacgacgttaggtttaactttcgttcggtaccttccggtacggtaacccaaccgtaaccaccggaacggaacctaaacccgacccccttaaacttagtaccgttaattacgtacgaccggtaccctaacgtaaccgcccgtaccctacggtaacggttactttacctactccgtacttcgtcgtccggactcgacgtgtacgacacgccgaccgtcctcgtacgaactacgtcgtaccgtcggccttacgcgacgtacgggaacgacggtacggtctacgtaactttaccgtacgtctaccgtactanacttacgaccgtaacactacctaactaacgtaaccgttccgtcgtacggaccggtcggaccgacgttccaccgtcgcggtacaccgtaccgacgtcccaaccgtgccctgccttcccg

SEQ ID NO: 175372 - DNA, 800 bp, Homo sapiens
  misc_feature: GYAE6OF01EOUMS.25.55.E11.1.454.CMB.1.raw
  modified_base (538)..(538): a, c, t, g, unknown or other
  misc_feature (538)..(538): n is a, c, g, or t
tcagactgtacagtcacgaccggtgctcgatttagcactcgcacgttgggtttggggctgggcctcaggaagcagcagtcggaggtgcctcagccagtggcagtcggactccctctccttccgtcggcgtccttgcttactcgcacgtaggtatttggtcgacccttcctagtggtaacgttcgacccgtagtcccgttccggtcggtcgttccgtcttcgtcggcagacacgccgactccctcctgtacctcgtacggtaccgttaagggcggacaggtaacgttcgtagttagtggttaggtactcggtaggtcgggaccggtccgggtccgtccgtaccgtacgttacgttacgtacttacgttacgttaacaactagtacggtacgtaccggacccggtcgtacggtacggttcctttcgttacgggttaccgttttcggacggtaccttacggtaacgtcgtaacggacccgttacggccctactcgttacttacgtttacggtcgggtaacggaccgaggtcgtagggttanaggtttacggtaaggtttcttacgtttacgttgacgttacgtggtacggttacgggtacgggtaccgtcggtacccgggtccgggttccggttacggccggggtccgggaccctacgggcgttaccgtacccggtcgttaccgggtcggaccgtacgggtaccccgtaggttccccgtacccggttacccgttagtacccgtccccgtttaccgttcccccgacccttacccgtccttaacgttaccgtggtaccgttcggg

SEQ ID NO: 175373 - DNA, 736 bp, Homo sapiens
  misc_feature: GYAE6OF01D0N4A.25.55.E11.1.454.CMB.1.raw
  modified_base (213)..(213): a, c, t, g, unknown or other
  misc_feature (213)..(213): n is a, c, g, or t
  modified_base (501)..(501): a, c, t, g, unknown or other
  misc_feature (501)..(501): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgccttactgcacgaggtatttgtcgacccttctatggagttcgacccagcctccggtggttcgtccgtctcgttccgggccagacncgcccacgccctccccgtgtacctcgtcggtacctttaaaggcggggacaaggtaagttctaggtattcggttaggtattcgtagttcggaccggcccgggtccgtactccgtaacttcgtagttacctagtttcgttaacaactagtcgagtacgccgtccctgacggtcttcgtacggttccgttttcgcgtcctacgtagtccgtaggtaccgtccgctactcgtactaacgtttcggtcggtaccggaaccgtgtagttcggagtagtagtaagttcttacttnttcgtgtacgagtcgttagggcgggtccgtccgtacggtcggtccggttacggcccgggtaccggacctacccggtgtacccgtaccggtacccgttacggtcgggtaccgacccggtaccggtacccggtcccgttacccccggtcccggttaccgttcccgtccccgttacccgttccccggtcccccgttcccgtacccgtaccgtttacccggtcgtaaccggttcccggg

SEQ ID NO: 175374 - DNA, 918 bp, Homo sapiens
  misc_feature: GYAE6OF01BBDDT.25.55.E11.1.454.CMB.1.raw
tcagactgtacagtcacgaccggtgctcgatttagcactcgcacggttgggtttggggggggtctcaggaggcagcgctctcgggacgtctccaccatggcctgggctctgctgttcctcaccctcctcactcagggcacgagggtcctgggcccagtctgccctgactcacgcctgcctccgtgtctgggaccttccgtggactaggtcggtacacctattccgtacctgcctacgtacgggaaccacggccggtagaccgtagtttcgggtacttactttaaataactattccgttccttcccgttacggtaaccccaaaccaaacccgtaccccggaacggtaccgtaaaaccccggaacccccctaaaagttacctaacttaacgttaaacgttttagttacgtaacgttacggtccgtaacgttaccgtaaccgtcccgggttacccttacgggttcggggtttacgttttccgggtcgttacccggttcctttccgtaccggttacgggtcccttaccgtaacggtccggttaccggacccttaacccggttcccgggtacccctttaccccgtacgggtacccgttaaccggttcccggggttccccggggtacccggttaccggacgggtaccgggtacggggaaaccggtaacgggttaccggtttcctttaaacgttttacgttacgtttcgggtaaacctttaccgttaaggtaccctaaacgggtaaacgtaaccgaaccctaaccgtaacgttaccgggttcgttacggggttaccgggagggtaacccgggtaaggttaaccgtacgggttcccggtaaccggttcgttaaccggccggtacggaaccccgtgtcccggacccggttcccccgtaacgccgttacccgttccgttacccccggg

SEQ ID NO: 175375 - DNA, 710 bp, Homo sapiens
  misc_feature: GYAE6OF01BIE4E.25.55.E11.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (335)..(335): a, c, t, g, unknown or other
  misc_feature (335)..(335): n is a, c, g, or t
tcagactgtacagtcacgaccggtgctcgatttagcactcgcacgttgggtttgggggggtctcaggaggcagcgctctcgggacgtctccaccatggcctggctctgctgttcctcaccctcctcactcaggcacagggtcctgggcccagtctgccctgactcagcctgcctccgtgtctgggactcctggacagtcggtcaccatcctcctgcactcggaaccngccgtnactnttggtgacttataactntgtctcctacgtcccaacaaccacccgagcaacgccccaaatcatctatttatgatgtctacgtcacgtcccggtcccttntcgggttagtttccgtcggttccgtcctttctaccgttcggtcctaccgtaacgttccgtcggtacctaacccgttcccggaccccttcccgtacgaccgtacgttcccggtccggggcctccgaggtcgtacggacgggaccgtaggttaccttactttagtttacgttgacctttatttacaacgttaacgacggaacaaccgtaacctaacgtccggtttacgttcggggttcggtaccgggacggggtaaccgggaacccgttaacgggttcccggtaaccccgttccggttaccgggtacctaccgggaccccgtaggtccccgtcccggtacccccgttacggttccctacccgttcccgttacccccg

SEQ ID NO: 175376 - DNA, 680 bp, Homo sapiens
  misc_feature: GYAE6OF01B25MN.25.55.E11.1.454.CMB.1.raw
  modified_base (661)..(661): a, c, t, g, unknown or other
  misc_feature (661)..(661): n is a, c, g, or t
tcagactgtacagtcacgaccggtgctcgatttagcactcgcacgttgggtttggggctgggcctcaggaagcagcatcggaggtgcctcagccatggcatggatccctctccttcctcggcgtccttgcttactgcacaggtatttgtcgacctcctatgagttcgaccccgagtcccgtccggtcggttcgtcccgttctcgttccgggccaggacacgcccacgccctcccgtgcctacgtggaccttaaggtgggacagtagtctgtatgtggtatgagttcggacgggtccggccgttctccgactcgtagtctattcgttacaactagtagattacggccgtccctaggtacggtctttcccgtaggttaccggtttcgcggtcctacgtagtcgtacgggtaccgtccggacctacgttctacttagtttacgttccggtacgggtacccgaggtgtggttaggtaagtagggtaaggttcgtttactttagtttccgtgtacgtacggtcggttcgggtcgggaccgtccggccggttcgggtccggttccgggtcggggccgggccctaccggcgtccgtccgtacccggtcggtcggccgcgacccggacgtccgcccgtccccgtcgtacctccgtcctcccgttacccncccttccactctgtcgtcg

SEQ ID NO: 175377 - DNA, 518 bp, Homo sapiens
  misc_feature: GYAE6OF02I1R8O.25.55.E11.1.454.CMB.1.raw
  modified_base (323)..(323): a, c, t, g, unknown or other
  misc_feature (323)..(323): n is a, c, g, or t
  modified_base (456)..(456): a, c, t, g, unknown or other
  misc_feature (456)..(456): n is a, c, g, or t
tcagactgtacagtcacgaccggtgctcgatttagcactcgcacgttgggtttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctntggagtttctggtcgcttctctggctcaagtctggcaactcggcctccctgaccatcgtcgggctccgaggctgaggacgaggtcctacttattattgctattcatacagagacacaacagtctgtgttcggnggaggaccagttcgaccgtcctcggtcacgccaaggctcgcccctcggtccacgtcttcccg

SEQ ID NO: 175378 - DNA, 541 bp, Homo sapiens
  misc_feature: GYAE6OF02HLUWF.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttctggctccaagtctgggactacggccactctcattattcgtgggacccaggatgtggatgaaggtgtctatttctgtcagctgtgggacggcaccgtcgcggtcttcggcggggcacccgagcgtgaccgtccgtggtccacgcccaggcctcggcccccgtcggtccacctcctcgttccccaccctccctccactcgtactacg

SEQ ID NO: 175379 - DNA, 525 bp, Homo sapiens
  misc_feature: GYAE6OF02I6UT8.25.55.E11.1.454.CMB.1.raw
  modified_base (454)..(454): a, c, t, g, unknown or other
  misc_feature (454)..(454): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggcctcagggattcctgaccggttttctggctccaagtctgggactacggccactctcattattcgtgggacccaggatgtgatgaaggtgtctatttctgtcagctgtgggacggcaccgtcgcggtctcgggcggggcacccgngctgaccgtcgtggtcagcccagctcgcccctcggtcactctcgttcccaccctccctcactcgtactacg

SEQ ID NO: 175380 - DNA, 514 bp, Homo sapiens
  misc_feature: GYAE6OF02GMMCV.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctctggagtttctggtcgcttctctggctcaagtctggcaactcggcctccctgaccatctcgggctccgaggctgaggacgaggctacttattattgctatttcattacagacgacaccaacagtctggtgttcggcgaggacagttcgaccgtcgtcggtcacgcccaagctcgcccctggtcactctccg

SEQ ID NO: 175381 - DNA, 518 bp, Homo sapiens
  misc_feature: GYAE6OF02HDH9S.25.55.E11.1.454.CMB.1.raw
tcagactgtacagtcacgaccggtgctcgatttagcactcgcacgttgggtttgggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctctggagtttctggtcgctttctctggctccaagtctggcaactcggcctccctgaccatcctcggggctccaggctgaggacgaggctacttattattgctatttcatacagagtacaccaacagtcctggtgttcggcgagggaccagttgacccgtctcggtcacgcccgaaggctcgcccctggtcactctccg

SEQ ID NO: 175382 - DNA, 554 bp, Homo sapiens
  misc_feature: GYAE6OF02I5P32.25.55.E11.1.454.CMB.1.raw
  modified_base (336)..(336): a, c, t, g, unknown or other
  misc_feature (336)..(336): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttnggctccaagtcgtggactacggccactctcattattcggtgggacccaggatgtggatgaaggtgtcttatttctgtcagtctggtgggacggcgaccgtcgcggtcgttcgggcggggcacccgagctcgaccgtcgtcggtcacgccgacggctccgccccgtcggtcctacgttccgtcgttccccgcccttccctcctaccgttcgtactacgg

SEQ ID NO: 175383 - DNA, 521 bp, Homo sapiens
  misc_feature: GYAE6OF02GLJNT.25.55.E11.1.454.CMB.1.raw
  modified_base (467)..(467): a, c, t, g, unknown or other
  misc_feature (467)..(467): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttgtatcagttgagccggcggtctccgactctagtcatgtttcaacatgatagacggccctcagggattcctgaccggttttctggctccaagtctgggactacggccactctcattattcgtgggacccaggatgtggatgaaggtgtctatttctgtcagctgtggacggcaccgtcgcggtcttcggcggggcaccgagctcgaccgtctggtcngcccaggctgcccctcggtcactcctcgttcccaccctcctcactcgtactacg

SEQ ID NO: 175384 - DNA, 531 bp, Homo sapiens
  misc_feature: GYAE6OF02IIAFB.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttctggctccaagtctgggactacggccactctcattattcgtgggacccaggatgtggatgaaggtgtctatttctgtcagctgtggacggcaccgtcgcggtcgttcggcggggcacccgagctgaccgtcctgggtcagcccaggcctcgccccctcggtccacctctcgttcccaccctcctcactcgactacg

SEQ ID NO: 175385 - DNA, 538 bp, Homo sapiens
  misc_feature: GYAE6OF02FPX0J.25.55.E11.1.454.CMB.1.raw
  modified_base (315)..(315): a, c, t, g, unknown or other
  misc_feature (315)..(315): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctnagggattcctgaccggttttctggctccaagtctgggactacggccactctcattattcgtgggacccaggatgtggatgaaggtgtctatttctgtcagctgtgggacgcaccgtcgcggtcttcggcggggcacccgagctgaccgtcctgggtcagcccaggctcgccccctcggtccaccgttctcggttccccgcccttcctccacctcgtactacgg

SEQ ID NO: 175386 - DNA, 526 bp, Homo sapiens
  misc_feature: GYAE6OF02GBHU3.25.55.E11.1.454.CMB.1.raw
  modified_base (341)..(341): a, c, t, g, unknown or other
  misc_feature (341)..(341): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccgtctccgactctagtcattgtttcaacatgatagaccggccctcgagggattcctggtaccggttttcncggctccaagtcgtgggactacggccactctcattattcgtcggacccaggatgtgatggaggtgtctatttctgtcagtctggtgggacgcaccgtcgcggtcgtcgggcgggcnccgngctgccgtcnggcacgccagctcgccctcggtccncgtctcgtcccnccctcctcnctcgactcg

SEQ ID NO: 175387 - DNA, 526 bp, Homo sapiens
  misc_feature: GYAE6OF02HV5WJ.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttctgggctccaagtctgggactacggccactctcattattcgtgggacccaggatgtggatgaaggtgtctatttctgtcagctgtgggacgcaccgtgccggtcttcggcggggcacccgagctgaccgtcgtggtcagcccaggctacggcccctcggtcactctgttcccgcctcctcactgtactacg

SEQ ID NO: 175388 - DNA, 543 bp, Homo sapiens
  misc_feature: GYAE6OF02G3J46.25.55.E11.1.454.CMB.1.raw
  modified_base (337)..(337): a, c, t, g, unknown or other
  misc_feature (337)..(337): n is a, c, g, or t
  modified_base (454)..(454): a, c, t, g, unknown or other
  misc_feature (454)..(454): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttcnggctccaagtctgggactacggccactctcattattcgtgggacccaggatgtggatgaaggtgtctatttctgtcagctgtgggacgcaccgtcgcggtctcggcggggcacccgngctcgaccgtccgtgggtcacgcccgaggcctcggcccccgtcggtccaccgtccttcgttcccctaccctccctccactcgtactacg

SEQ ID NO: 175389 - DNA, 578 bp, Homo sapiens
  misc_feature: GYAE6OF02HGTYX.25.55.E11.1.454.CMB.1.raw
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (513)..(513): a, c, t, g, unknown or other
  misc_feature (513)..(513): n is a, c, g, or t
tcagactgtacagtcacgaccggtgctcgatttagcactcgcacgttgggtttgggtcgtgggcctcaggaagcagcatcggaggtgcctcagccatggcatggatcctctcttcctcgcgtccttgcttactgcacaggatttgtgacctcctatgagttgacccagcctccgtcggtgtccgtctcttcggccagacagcagcctccctgctctgccttaaaggtgggcagaagtctgtagtgttgacttatcagttgaggccgggccgtctcccgactctagtcattcgtttacaacatgattagacggtcccctggagtcctcgtacggttcgttcgcgtcacgtagtcgngtacgcgcnctcgtatattcncgggttaccgacgaagctggngtagagtagtntacttgtcgtntagagtcgtagggtcgacgccgtacgtcggtcgttacggtcgggaccgactccgacgtcaaccggtcgtccgtaggccacggtaacgcgtaccncccggtccccgtgtaaccgccttacggttcccgtccccctccggtcctacgttccggacttaacg

SEQ ID NO: 175390 - DNA, 746 bp, Homo sapiens
  misc_feature: GYAE6OF02JOP4M.25.55.E11.1.454.CMB.1.raw
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (298)..(298): a, c, t, g, unknown or other
  misc_feature (298)..(298): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacngttggtgcttataactntgtctcctgtccaacacaccagcaacgaccccaactcatcattangtatgacagtctactccgcctcgtggtacgtttcgtcggttcgtccttcgtctggccttaccgtaagtcgtggacctaacgtcccggtccctacccgtacgacctacgtccggtacgggtcctccgaacggtccgtagggacggtaccggtagtacccgtttacgtttaagttacgtttacggtaccttaactttacgtaacttaaaccggacggttaaacaaacccgtaacccctaaaacgttaccggttaccggtttacggggtttacgggtttacccggggaaccggggtaacggggttaacccgtacggggttttaccggtaaccccgggtttccccggttaaccggttcccgggtaaaccgtaccccggtaacgggttccccggttaccccggtaccccccggtttacgggttaccctaccccggtttcccgtttaacccccg

SEQ ID NO: 175391 - DNA, 544 bp, Homo sapiens
  misc_feature: GYAE6OF02FJ80N.25.55.E11.1.454.CMB.1.raw
  modified_base (339)..(339): a, c, t, g, unknown or other
  misc_feature (339)..(339): n is a, c, g, or t
  modified_base (403)..(403): a, c, t, g, unknown or other
  misc_feature (403)..(403): n is a, c, g, or t
  modified_base (457)..(457): a, c, t, g, unknown or other
  misc_feature (457)..(457): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggatttcctgaccggtttttcnggctccaagtctgggactacggccactctcattattcgtgggacccaggatgtggatgaaggtntctatttctgtcagctgtgggacgcaccgtcgcggtcttcggcggggcacccgngctcgaccgtcctgggtcacgcccaggcctcggccccctcggtcccacgtcctcgttccccacccttccctcaccttcgtacctacg

SEQ ID NO: 175392 - DNA, 562 bp, Homo sapiens
  misc_feature: GYAE6OF02H4RII.25.55.E11.1.454.CMB.1.raw
  modified_base (558)..(558): a, c, t, g, unknown or other
  misc_feature (558)..(558): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtgcttataactatgtctcctgtacccaacaacaccagacaacggcccccaaactcatctatttatgatgtacagtcacgtccggccctcgtggtacgtttcgtggtcgtcttctcgtcggcctccgaagtctggacctaacgtccggtccctccgtcgaccctatccggtccggggctccgaggctggacggacggacggtcttaacgtttaattacgttgctatttacatacagacgacaccaatagtcgtggttcggtcggacggaggtacctagttccgacgtcgtcgcacgccaggctcgccctcgtcacctntccg

SEQ ID NO: 175393 - DNA, 642 bp, Homo sapiens
  misc_feature: GYAE6OF02G10C5.25.55.E11.1.454.CMB.1.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccagccgtgactattggtncttataactatgtctcctggtcccaacaacaccaggcaacggcccccaaactcactctattatgatgtcagtcactcgcctntggtacgtttctggtctcttctctgctcagtctgcacgtcgcctcctgacctactccgtcgggcctccgaggtctaggacgggacgacggtaccttacttagttacttcgtacttactttacaacttacgacgtaacgaacctaaccgtaaactacggttacgttagggttcgggttaccgggacgggtaacgggtaacccgtacggtttaccggtacccggttcccggttaccgggtaccgaaccggtaccccgtaacggtcccgttcccggtaccccccgttcgggtaccctacccgttcccggttacccccgg

SEQ ID NO: 175394 - DNA, 523 bp, Homo sapiens
  misc_feature: GYAE6OF02GJHXJ.25.55.E11.1.454.CMB.1.raw
  modified_base (304)..(304): a, c, t, g, unknown or other
  misc_feature (304)..(304): n is a, c, g, or t
  modified_base (446)..(446): a, c, t, g, unknown or other
  misc_feature (446)..(446): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacaccaggcaacggcccccaaactcatcatttangatgtcagtcatccggccctcgtggtagtttctggtcgtctttctctggctcaagtctggcaactcgcctcctgaccatcgtcgggctccgagctgacggacgaggctacttattagtgctatttcatacagagaccacaangtctggtgttcggcggaggacctagtcgaccgtcctcggtcacgccaaggcctccgcccctggtcctacctctcccg

SEQ ID NO: 175395 - DNA, 549 bp, Homo sapiens
  misc_feature: GYAE6OF02GLBT5.25.55.E11.1.454.CMB.1.raw
  modified_base (305)..(305): a, c, t, g, unknown or other
  misc_feature (305)..(305): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacacccaggcaacggcccccaaatcatcatttangatgtcagtcatccggccctctggtatttctggtcgtcttctctggctcaagtctggcaacgtcggcctcctgaccatcgtcgggctccgaggctggacggacgaggtctacttattattgactatttcatacagacgaacaccaaatcgtactggtcgttcggacggacggacctagttcgaccgttccgtcggtcacgacccgaaggtcctccggtcccccgtggtacctacgtcttacccg

SEQ ID NO: 175396 - DNA, 685 bp, Homo sapiens
  misc_feature: GYAE6OF02GOQ9E.25.55.E11.1.454.CMB.1.raw
  modified_base (236)..(236): a, c, t, g, unknown or other
  misc_feature (236)..(236): n is a, c, g, or t
  modified_base (347)..(347): a, c, t, g, unknown or other
  misc_feature (347)..(347): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcgttcgggccagacagccagccctcccctgcctctggaccttaaaggnggggcagaagtctgtatgtgtatcagtgaggccgggccgtctccgactctagtcattcgttacaactatgatagaccggccctgagggtacttccgtgtacccggttttcnggtcctaccgaagtcgtaggggacctaccgggcctactcctactatttacgttccggtcgggaacccctagggacgttggtagggtacgttaggtaaagggttcgtttacgtttaagttttccgtggttacgacggtcgttagggttacggggaccggtccgtacccgggttcggtccgggttccggttcggggcccgggggtaccacccggaggtccgtacggtacccggttccgtcgggtccacggcccgacggccgtcccggtcccccgtcggtccctaccgttccgttcccggtccccgtccccgttacctccgtaccttcgtacccgttacgg

SEQ ID NO: 175397 - DNA, 739 bp, Homo sapiens
  misc_feature: GYAE6OF02JGG40.25.55.E11.1.454.CMB.1.raw
  modified_base (302)..(302): a, c, t, g, unknown or other
  misc_feature (302)..(302): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcggccagacagccagcctcccctgctctggccttaaagtgggcagaagtctgtatgttggtatctagttggacggccggccggtctccgactctagtcattgttcaacgtntgatagaccgccctacgagggtacttccgtcggttacccgttttcgcggtcctaccgtaacggttcgtacggggtaacctaccggccctaacttccgtactaacgtttacgttcccgggtacgggaacccgtaggtaacgttgggtaggtacggttaggtaaaggttcgttacgtttaacgttttcgtacggttcgtaacggttcgttacgggtcggggtaacccggtccggtaaccccgggttccgggttcccgggttccgggttcccgggggtccgggggacccgtaccccggaacgttccggtaccggtacccggttccggtacgggttccgaccgacccggtacggccgtcccggtcccccgttcggtaccgtcccgtcccgttccggtcccccgtcccgttccgtacccgtacgttaccgtaccgttaccgg

SEQ ID NO: 175398 - DNA, 521 bp, Homo sapiens
  misc_feature: GYAE6OF02I5Y5O.25.55.E11.1.454.CMB.1.raw
  modified_base (455)..(455): a, c, t, g, unknown or other
  misc_feature (455)..(455): n is a, c, g, or t
  modified_base (504)..(504): a, c, t, g, unknown or other
  misc_feature (504)..(504): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgtaccggttttctggctccaagtctgggactacggccactctcattattcgtgggacccaggatgtgatgaagtgtctatttctgtcagctgtgggacgcaccgtcgcggtcgttcgggcggggcaccgngctgaccgtctggtcacgccagctcgcccctcggtcactctcgttcccncctcctcactgtactcg

SEQ ID NO: 175399 - DNA, 816 bp, Homo sapiens
  misc_feature: GYAE6OF02HE4NF.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacgagggtcctgggcccagtctcgccctgactcacgcctgcctccgtgtcgtgggacctccgtggacaggtcggtcaccatcctcctgcctacgtacggaaccaggtcccgtagaacctagtttgggtctactttaagtaaacttattcggttccttcccgttacgggtaccccaaaccgaaacccaccccgaacgggacccgaaaccgggaccccccaaaactcctaactacctaattttacgtagtaacttcgtacacgttccaacgtccggccccttcgtcggttacgttttcgtcggttccggtcctttacgtcgttcgggtaccttaccgtaacggttccgtcgggtacctaaccgttcccggtacccttcccgtacgacctacgtccggtccgggtcctccggacggtcgtaggacggacggtacggtaccttacgtttaagtttacgttacgtacttaacgtttacaacgttaacgaacgaacctaaccgtaacccgtaaacgttacgttaccggtttacgggttcgggtttaccggggaccggggtaacgggaacccggttaacggttccggtacccggttcccggtaccgggttaccgacccggtaacccggaacggtcccgtacccggtcccccggttacggtcccgttaccgttcccgtttacccccgg

SEQ ID NO: 175400 - DNA, 622 bp, Homo sapiens
  misc_feature: GYAE6OF02IFO9Y.25.55.E11.1.454.CMB.1.raw
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccggcggtctccgatctattcatgtttcaacntgatagacggcctnaggattcctgtaccgtttntggctctaagtctggactacggcctactctctattacttcggtacggacccaggtntggtggataggtaaggttgtacttatttcgtgtcagtcgtggtcgggacggctaccggtcgtccgggttcgttccggggcggggtacctacccgacggtccgtacggacccgttccggtacgggtccgtaaccggacccgaacgggtccgtcccggtccccccgttcggtaccctaccgttcccgttccggttcccccgtccccgttcccgtaccgtaccgtccgtaccgtaccgg

SEQ ID NO: 175401 - DNA, 651 bp, Homo sapiens
  misc_feature: GYAE6OF02HXTEB.25.55.E11.1.454.CMB.1.raw
  modified_base (342)..(342): a, c, t, g, unknown or other
  misc_feature (342)..(342): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctcgtcggtgtccgtctcttcgggccagacagccagcctcccctgctctggccttaaagtggggcagaagtctgtatgttggtatcagttgaggccgggccggtctccgactctagtcatgtttcaacatgataggacgccctcgagggatttcccgtgtaccggtttttcnggtctcctaagtcgtcgggactacggcctactctcattattcgtgggacccagggatgtggatagtaaggtgtcttatttcgtgtcgtagtctggtcgggacgcgtaccgtcgccggtcgttcggggcggggtaccacccgagtccgtcggtacccgtccgttcgggtaccgacggtaccccgaacgggtcctacccgggtcccccccggttaccgggttaccaaccccgtttcccgtcccggtttaccccccctaacccccgtttcccgttacccctacccggtttaccggttaacccttaacccggg

SEQ ID NO: 175402 - DNA, 558 bp, Homo sapiens
  misc_feature: GYAE6OF02GUGOO.25.55.E11.1.454.CMB.1.raw
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccgtctccgactctagtcatgtttcaacatgatagacggccctnagggattcctgaccggttttcnggctccaagtctgggactacggccactctcattacttcgtcgggacccaggtatgtggatggtaaggtgtctatttcgtgtcagcttggtgggacgtcaccggtcgcggtcgttcgggccggggccacccgagtcgtcgaccgtccgtcggtcgacgcccgaggcctccggccccctcggtcctaccgtcctcgttccccaccctcctccacttcgactcgg

SEQ ID NO: 175403 - DNA, 757 bp, Homo sapiens
  misc_feature: GYAE6OF02GAQXG.25.55.E11.1.454.CMB.1.raw
tcagactgtacagtcacgaccggtgctcgatttagcactcgcacgttaggtttggggggtctcaggaggcaagtcgcgtctcggggacgtcctccaccactgggcctgggcctctgaactgttccctcaccctccgtcactcacggcacagggtcctgggcccagtctgcccgtgactctagcctgcctccgtgtcgtggactcctggacagtcggtcaccgatacgtcctggccacctcggaacccagccgtcgaccattagggtcacttactaaccttactgtctccctggtcccaacaacgaccagaccaacggcccccaaactcactacacgtttactggactgtccaggttcaagtccggtacccttcctcggtacgtttccgtcgggttccgtcgtttccgtccggttcggtccgtcccgtaaaggttccgtggacctaaaccgttccggacccttccccgttcgaccctagtcccgtccgggggtccttcccgaagggtccttcgggaacgggaaccggtaacgggtccttaacgtttaactttaagtttggacctaatttttccaatttaacgaagtaacgaaccaacccaaactcggttaacgttgggttacggtttaccgggcgggaacggggtaccctaaggtttccggaacccggtttcccgttccgggttccaacggtaccccgtaaagggtcccgttaccggacccccccggtttcgggtccctaccgttcccgtttccccgg

SEQ ID NO: 175404 - DNA, 823 bp, Homo sapiens
  misc_feature: GYAE6OF02IBKX1.25.55.E11.1.454.CMB.1.raw
  modified_base (198)..(198): a, c, t, g, unknown or other
  misc_feature (198)..(198): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatctcctgcactcggaaccaggcccgtagactagtttgggtcgtactttaactaacttattcggttcctccgttacggtaccccaaacaaccaccccgaaggaccaaaccggacccccctaaaactcaacttacctaactttttaagacgtaacttgtacctagtacctacgtccggtccctcggttaggtacgtttcgtcgggttctctttctcgtacggtctaccaagttcgtcggtacctaaccgttccggtcccttacccgagtacccctagttccggtcgggtccctaccggacggtccgtagggaccggaacggtacggtacctttaacgtttacgttaacgtttcgtactttactttacgtaacgtaccgaagtaaccggaacctaacccgtaacgtacggtttacccggtttaggggttacccgggttaccgggaaccgggggttaaccgggtaacccgttaaccgggggttttacccggtaccccgggtttacccgtttaacccgggggtcccaaccccgggttaccccggtaacggttcccggttacccccgggttccccccggttccgggttacccttaccccggtttcccgttaccccccggg

SEQ ID NO: 175405 - DNA, 639 bp, Homo sapiens
  misc_feature: GYAE6OF02INHOR.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccacgcctcccctgcctctggaccttaaaggtggggcagagtctgtatgtgtatcagttgaggccggccgtctccgactctagtcatgtttacaacatgagtagaccggccctacgagggtacttccctggtacccggttttcgtggtcctaccgtaagtcgtggggacctaccggccacttcctctatttagttccgtacgggtacccctagggattggtggagttaggaaggttcgttcttagtttcgtgtctacgtcgttcgggttgggaccggtccgaccggtccggtccggttccggttcgggccggggaccacccgcgccgtcgtacccgttccggtcggtacgaccgcccgtacggccgtcccggccccgtccggtccgtaccgtccgttccgttccccgtccctcctccgtacgttacgtcgtaccgg

SEQ ID NO: 175406 - DNA, 732 bp, Homo sapiens
  misc_feature: GYAE6OF02GOOOZ.25.55.E11.1.454.CMB.1.raw
  modified_base (243)..(243): a, c, t, g, unknown or other
  misc_feature (243)..(243): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtncttaataactatgtctcctggtcccaacaacaccaggcaacggcccccaaactcatcatttatgatgtcagtcatcggccctcgtggtagtttctggtcgtcttctctggtctccgaagtcgtggcaacgtccggcccttcccgtcgacctacgttccgtccggggccttaccgagggtcctagggacgggaaccggacgggtaccttaacgtttaagtttacgtttacggtccttaacttttaccgtaattaaccgaagtaaaccggtaaccctaaacccgtaaacgttacggttaccgtttggggtttaccggttaccgggaacccggggtaacggggtaacccgttaacgggtttaccggtaaccccggtttcccggttacccggggttaccgtaacccggtaccccggtaaacggttcccggtccccggtacccccccggtttaccgggttacccgttacccgtttccccggttttacccccggg

SEQ ID NO: 175407 - DNA, 804 bp, Homo sapiens
  misc_feature: GYAE6OF02IH721.25.55.E11.1.454.CMB.1.raw
  modified_base (310)..(310): a, c, t, g, unknown or other
  misc_feature (310)..(310): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactctggacagtcgtcaccatctcctgcactggaaccagccgtgacattggtgcttaataactatgtcctcctcggtacccaacaacacccaggaccaacggccccccaaatcatctatttangtatgtcagtcagtccggccttcgtggtacgtttcgtcggtccgtctttctcgttaggccttaccgtaaagttccgtaggtaacctaacccgttcccgggtccccttaccccgttacgaaccccgttacggtttcccggtcccgggggtacccttaccgggaaaccgggtcccgttaacggggaaacgggtacccgggtaacggggttaccctttaaccgttttaacgttttaacggtttccgtaccgtttaacgttttaccaaggtttaacctaacgggaacgtaaaccccgtaacctaaaacgttcgggtttaccgtacggggttttacgggttcccggggtaaaccggggtacgggtaacccgttaaggttccgggttaaacccccggttcccggttaaccggggaccgtaaccgggtacccccgtaaagggtccccggttacccggtcccccccgttacgggtacccttaccccggttcgtttacccccg

SEQ ID NO: 175408 - DNA, 522 bp, Homo sapiens
  misc_feature: GYAE6OF02JC2H5.25.55.E11.1.454.CMB.1.raw
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (462)..(462): a, c, t, g, unknown or other
  misc_feature (462)..(462): n is a, c, g, or t
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttgtatcagttgaggccggccggtctccgactctagtcatgtttcaacntgatagacgccctnaggattccgtgaccggttttcnggctccaagtcgtgggactacggccactctctattattcgtcgggacccaggatggtggatgaaggtgtacttatttctgtcagtcgtggtggacggcaccgtcgcggtcgtcggcgggcaccgagcncgccgtctggcacgccagctcgcccctgtcncgtctcgtcccaccgtccncnctctntcg

SEQ ID NO: 175409 - DNA, 512 bp, Homo sapiens
  misc_feature: GYAE6OF02JCA0I.25.55.E11.1.454.CMB.1.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacntgatagacggcctcagggattcctgaccggttttcnggctccaagtctgggactacggccactctcattatcgtgggacccaggatgtgatgaaggtgtctattctgtcagctgtgggcgcaccgtgcggtcttcgggcggggcaccgngctgccgtcgtggcagccgagcncgccctcggtcnctcgtcgtcccgcctccncnctgtctcg

SEQ ID NO: 175410 - DNA, 537 bp, Homo sapiens
  misc_feature: GYAE6OF02FXMCM.25.55.E11.1.454.CMB.1.raw
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (402)..(402): a, c, t, g, unknown or other
  misc_feature (402)..(402): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtgggcagaagtctgtatgttggtatcagttgaggccgggccggtctccgactctagtcatgtttcaacntgatagacggccctnagggattcctgtaccggttttcnggcctccgaagtctgggactacggcctactctcattatcgtgggacccagatgtgatgtaaggtntctattctgtcagctggtgggacgcaccgtcgcggtcgttcgggcggggccaccgagcgtcgccgtccgtggtcacgccagtcgcgtcgcccctcggcctaccgtcgtcttcccaccctcctccgtactcgtacc

SEQ ID NO: 175411 - DNA, 712 bp, Homo sapiens
  misc_feature: GYAE6OF02GATL0.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtgcttataactatgtctcctcggtccccaacaacaccaggccaacggacccccaaactcatctattatgatgtacagtcactccggccctcgtggtagtttcgtggtccgtcttctcgtggtcctaccaagttcgtggacctaaccgtccggtcccttcccgtacgtaaccctacgttccggtaccggggtcccttaccggacgggtcgtacgggacggggtaacggtacgggtacctttaacggtttaactttacgtttcggtacttaacttttaccaagtttaaccgagtaacgtaacccaaccgtaaactacgttcgttggggttacggttaccgggacggggtaaccgggtaaccgtacggttaccggtacccggttcccggtaccgggttaccgtaaccggacccggtaacgggtccctccccgggtcccccggttccgggtacccttaccggttccctttccccg

SEQ ID NO: 175412 - DNA, 802 bp, Homo sapiens
  misc_feature: GYAE6OF02I11E7.25.55.E11.1.454.CMB.1.raw
  modified_base (343)..(343): a, c, t, g, unknown or other
  misc_feature (343)..(343): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccgtctccgactctagtcatgtttcaactatgatacgacggccctcgagggtacttcctggtaccggttttcncgtactacctagtcgtagggactaaccggtccacgtctactaatttagttccggtacgggaaccctagggaacgttggtacggtaagtaggtaaagggttcgttacgtttaatttcgttacggttcgtaacggtcgttagggttacggggaccgggtaccgtaaccgggtcccgggtccgggttcccggtttcccgggggtaccgggggggtccctaacccccggtacgggtcccggttacggaccccgggtttacccggtaccggggtaaccccgaaccgggtaccccccggtaaaggggccccgttacccgggttcccccccccggtttaccgggggtacccttaaacccccggtttccccggtttaccccgggttttaccccccccgtaaccccccgttttacccccgttacccgttaaaccccggtttacggtttaacccccggttaaacccggg

SEQ ID NO: 175413 - DNA, 526 bp, Homo sapiens
  misc_feature: GYAE6OF02I16XB.25.55.E11.1.454.CMB.1.raw
  modified_base (336)..(336): a, c, t, g, unknown or other
  misc_feature (336)..(336): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccgtctccgactctagtcatgtttcaacatgatagacggccctcagggattcctgaccggttttcnggctccgaagtctgggactacggccactctcattatcgtgggacccaggactgtggatgaaggtgtctatttctgtcagctggtggacgcaccgtcgcggtcgtcggcggggcaccgagctagccgtctggtacacgccgaggctcggcccctcggtcactctcgttcccaccctcctccactgtactcg

SEQ ID NO: 175414 - DNA, 675 bp, Homo sapiens
  misc_feature: GYAE6OF02ISYXZ.25.55.E11.1.454.CMB.1.raw
  modified_base (358)..(358): a, c, t, g, unknown or other
  misc_feature (358)..(358): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccacgccctcccctgcctctcggccttaaaggtggggcagaagtctgtatgttggtatcgagttgaggccgggccggtctccgactcgtagtcattgtttacaactatgatacggaccggccctgagggtacttcccgtggttacccggttttcnggtcctaccgaagtccgtacgggaccgtaccggcctactctctagtttacgttcggacgggtacccagggtatggtggagtaggtaaggtgttcttagtttctgtcgagtcgtggtcgggtaccggcgtaccggtcggtccggttcgggttccggggccggggtacctacccgtagtccgtccggtacccgttccggtacgggtccgaccgacccggtacgggtccgtcccggtcccccggttccggtcctacccgttcccgttcccggttacccccgccccttacccgttcccgtaccgttacgttaccgtaccgg

SEQ ID NO: 175415 - DNA, 543 bp, Homo sapiens
  misc_feature: GYAE6OF02FX6YA.25.55.E11.1.454.CMB.1.raw
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (451)..(451): a, c, t, g, unknown or other
  misc_feature (451)..(451): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggcggccggtctccgactctagtcatgtttcaacatgatagacggccctnagggnttcctgaccggttttcnggctccaagtctgggactacggccactctcattatcgtgggacccaggatgtgatgaaggtgtcttattctgtcagcttggtgggacgctaccgtcgtcggtcgttcgggcgggcncccgagcgtcgaccgtccgtggtcacgcccgaggctccggccccgtcggtccaccttcgtccgttccccgcccttccnccncgttcgactcg

SEQ ID NO: 175416 - DNA, 603 bp, Homo sapiens
  misc_feature: GYAE6OF02IJHRF.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctccctgctctggccttaaagtggggcagaagtctgtatgttggtatcagttggaggccgggcggtctccgactctagtcatgtttcaactatgatagcggcctcagggtattccgtgtaccggttttctggtctccaagtctagggacctacggcctacgtctacatttacttcggtacgggacccaggtatggtaggtatggtaaggttgtacgttatttcgtgttactgcgttggttcgggaccggtcgtaccggtcgtcgggtccgttcgggccggggaccacccgacggtctcggaccgtccgtcggtccgacgcccgaggcctccggccccgttcggtcctaccgttccgtcgttccccgcccttcccgtacctacgttcgtactacgg

SEQ ID NO: 175417 - DNA, 523 bp, Homo sapiens
  misc_feature: GYAE6OF02GX5XL.25.55.E11.1.454.CMB.1.raw
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtggcctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacntgatagacggccctcagggattcctggaccggttttcnggctccaagtctgggactacggccactctcattatcgtgggacccnggactgtggatgaaggtntctatttctgtcagctgtgggacgcaccgtgcggtcttcggcggggcncccgngctgaccgttcnggtcncgccgagctcgccccgngtccnctctcgtcccaccgtcctcgctcgctcgg

SEQ ID NO: 175418 - DNA, 689 bp, Homo sapiens
  misc_feature: GYAE6OF02F70IG.25.55.E11.1.454.CMB.1.raw
  modified_base (217)..(217): a, c, t, g, unknown or other
  misc_feature (217)..(217): n is a, c, g, or t
  modified_base (565)..(565): a, c, t, g, unknown or other
  misc_feature (565)..(565): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcgttcgggccagacagccagccctccccngctctggccttaaaggtggggcagagtctgtatgttgtatcagttgaggccgggccggtctccgactctagtcattgtttacaacatgatacgaccggcctacgacgggtacttcccgtagtacccggtttttctgggtccttccgaaaggttccgtggggacctaccgggcctacttctactaatttacgttccggtacgggaccccgtagggtacgttcggtgggtattcgggtaaagggttgttaccttagttttccgtggttaccgagtcgttgggttcggggacggtaccgtacccggtccggtccgggttccggttccggggtccgggggacccgtacccgnggtccgtcggtacccgttccggtgggtccgacgacccgtacggcctccggcccccgtcggtccgtacccgttccttacccggttccccctccccgttccctaccaccgttcggtaccttccggg

SEQ ID NO: 175419 - DNA, 664 bp, Homo sapiens
  misc_feature: GYAE6OF02IF98F.25.55.E11.1.454.CMB.1.raw
  modified_base (343)..(343): a, c, t, g, unknown or other
  misc_feature (343)..(343): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagccctcccctgctctggccttaaagtggggcagaagtctgtatgttggtatcagttgaggccgggccggtctccgactctagtcattgtttcaacatgatagaccggcctgacgggtattccgtgtaccggttttcnggtctccgaagtcgtagggtactacggcctactctactattattcggtcgggtaccctagggtactggtaggtacgtaggtaagggtgtacttagtttcgtggtcaggtcgttgggtcgggaccggtaccgtacccggttcggtccgggttccggttcggggccgggggtaccacccgagccgtcggtacccgtccggtcgggtccacggacccgacggtccgtccggtaccccccggtcgggttaccctaccgttcccgttccgggtttccccccgtcccgtttacccgttacccgacgtttccggtaaccgttaccggg

SEQ ID NO: 175420 - DNA, 755 bp, Homo sapiens
  misc_feature: GYAE6OF02F2AQW.25.55.E11.1.454.CMB.1.raw
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttgggtgtactttaataacttatcgttcctcctcggtacccaacaaccacccaggacaacggaccccccaaactcactactatttatgatgtcagtcagtccgcctcgtggtagtttcgtggtcgtcttcttcgtcggtcctacctaagttcgtcggacctaacgtccggcccttcccgtcgaacccgtcgttccgtccggggtcctaccgcgggtccgtagggaacgggtaacgacgggttacctttaactttaagtttacgtttgtacctttaacgtttaccaagttaaccgaacggtacgaaaccaacccgtaaacgttacggttacgttcgggttacgggttaccggggacggggtaacgggtaacccgttaagggtttccggtaaccccggtttcccgggtacccggttaacccggaacccgggtaacccccggttaacgggtcccccgtttaccccgggccccccggtttaccgggtaccccgttacccgtttaccccggtttcccccggg

SEQ ID NO: 175421 - DNA, 738 bp, Homo sapiens
  misc_feature: GYAE6OF02H9RPZ.25.55.E11.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (333)..(333): a, c, t, g, unknown or other
  misc_feature (333)..(333): n is a, c, g, or t
  modified_base (381)..(381): a, c, t, g, unknown or other
  misc_feature (381)..(381): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacntctcctgcactggaaccngccgtgactagttgggtgtactttaagtaaactnttgttcctccgttggtaccccaaacaacctacccgaggaccaaccggacccccaaaatctaatcctattttagngtactcgtacagtccgaattcccgggaccctcgttaggtacgtttcgnggttcctctttctcgtggtcctaccgtaagtcgtcgggacctaacgtccggtcccctccgtactaacccgtagttccgtccgggggtcctacccgtaggtccgttacggacgggtaccggacggtacctttaacttagtttacgtttagtacgttactttactaactacgtacgaaccgtaaccaaccgtaaacctcggttcgttagggttacgggttacgggacgggtaaccgggaacgttaaccggttccggtaacccggttccgtaccggtaccgtaccggaccccgtaacgggtacccgttccccgggtaccccccggttacggtacccgttaccccgtcgttaccccccggg

SEQ ID NO: 175422 - DNA, 907 bp, Homo sapiens
  misc_feature: GYAE6OF02HEAYB.25.55.E11.1.454.CMB.1.raw
tcagactgtacagtcacgaccggtgctcgatttagcactcgcacgttgggtttggggggtctcaggaggcagcgctctcgggacgtctccaccatggcctgggctctgctgttcctcaccctctcactcagggcacagggtcctgggcccagtctgcctgactcagcctgcctccgtgtctgggactccgtggacagtcggtcaccatctcctgcacgtggaacctgccgtgacctagttggtcacctttaagtaaaccttagtcggttcctaccgttcggttaccccaaaactaaaccgtaacccccgtaagggacccaaaaccgggaccccccctaaaaaacttcccgaaacgttacctaaactttttaacgtacggtaacgttcggtaccgtaaacggtttccgaaaccgttcccgggtacccctttccggttacggggttaaaccggtttttccgtacggggttacccggttccgttttaccgttccgttacggggtcccttaacccgtaaaggtttccggtacggggtaccctaaaccgttcccgggtaccccttaccccggttcggtaacccctaaggtttccccgggtccgggggtacccttacccgggtaacgggtcccgttacggggtaaacgggtaaccggttaacggggtaccttttaaaccgtttaagtttaaccgtttcgggtaccgttaattttaaccgaacttaaccgttaacggaaccggtaaaccctaaccggtaaaccgtcggtttaccgttacggggttacggtttacgggaacccggggtaaggtaaccccgttagttccggtacccgtacggttccggtacacggtacccgtaagggtcccttaccggtcccccggttaggtacccttaccgttccgttccccggg

SEQ ID NO: 175423 - DNA, 708 bp, Homo sapiens
  misc_feature: GYAE6OF02GTESX.25.55.E11.1.454.CMB.1.raw
  modified_base (234)..(234): a, c, t, g, unknown or other
  misc_feature (234)..(234): n is a, c, g, or t
  modified_base (333)..(333): a, c, t, g, unknown or other
  misc_feature (333)..(333): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagccctccgtcggtgtccgtctcttcgggccagacagccagccctccctgctctggccttaaaaggnggggcagaagtctagtatgttggtatcagttgaggccgggcgtctccgatctagtcatgttacacatgatgacgcctgaggatccgtgtaccgttttcnggtactccgtaaagtcgtagggactacggcctactcgtctaagttacgttcgtcgggaaccctaggtacttggtacggtagtaggtaaagggttgtacttagtttcgttagtctaacgtcgtagggtacgggtaccggccgtaaccgggttccggtcgggttccggttaccggggccggggggtaccctacccggtaacggtccgtaccggtacccggttccggttacgggtaccgtaaccgacccggtaacgggtcccgttacccggtccccccggttccgggtacccgttaacccgttcccgttacccggtttacccccgtaaccccgtttcccgttaacccgtaccgtttaccggtaaccggttaacccggg

SEQ ID NO: 175424 - DNA, 626 bp, Homo sapiens
  misc_feature: GYAE6OF02JHGX6.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggcccagacagccagcctcccctgctctggacttaaagtggggcagaagtctgtatgttggtatcagttgacggccgggccgtctccgactctagtcattgtttcaacatgaatagacggccctcgacgggtacttcctggtaccggtttctggctccaagtctcgggactacggccactctatattacgttcggtcgggacccagggtatcggtgggtaacttaggaacgggttcgttcttagtttcgttgtactaggtccgttggtcggggtaccggccgtacccggtcggtaccggtccggttaccggggcgggggtaccacccgaggtccgtcggacccgttcgtcgggtacctacggacccgaggcccgtcgcccccgttggtactaccgtcgtccgttccccgccctcctccgtactctacgtaccg

SEQ ID NO: 175425 - DNA, 606 bp, Homo sapiens
  misc_feature: GYAE6OF02IU1BX.25.55.E11.1.454.CMB.1.raw
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcgagggactttcctgtaccgttttcnggtctccagtctagggactaccggccactctctaatttatcggtggacccngggatgtggactgaggtgtacttattctgtcagntaggtggacggctaccggtccgcggttcgttcgggcggggtcccaccgaggtacctggacccgtccgtcgggtacgaccgcccgtacggccgtcccggccccccgttacggtccctacgttcccgtttaccgttacccccctacccgttccctacccgtacctttaccggaccgttaccgg

SEQ ID NO: 175426 - DNA, 753 bp, Homo sapiens
  misc_feature: GYAE6OF02HICHZ.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccggtcggtgtccgtctcgttcgggccagacagccacgccctcccctgcctcgtgggtaccttaaaaggtcggggacaagtaacgttctaggtattggttggtatcgtaggttggacggccgggccgtctaccgacttctagtccattcgtttacgaatactgtaagtaacggaccgggtacccctcggtaacgggtactttaccgttcggttacccggtttttctcgggtacctaccgaaacggttcgtacggggtacgtaccggaccgtacctacttacgtaatttaccgttacggtccgggaacccgtaggtagttcggtacggtgttaagggaaacgggttgtactttaactttcgtcgtacgacgtcgtgggttacggggacgtcccgtaccggtcggttaccgggtccggttacggggccggggtacccaccgtacgggtcgtccggtaaccccggttcgtacgggtacccgaacgacccggtacgggtccgtacccggtaccccccggtcggttaccaccggtttcccttccgggttccccctaccgtccctacggtactaccggtacctacgg

SEQ ID NO: 175427 - DNA, 648 bp, Homo sapiens
  misc_feature: GYAE6OF02IPZTZ.25.55.E11.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
tcagactgtacagtcacgaccggtgctcgatttagcactcgcacgttgggtttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtnacagttggtncttataactatgtctcctggtcccaaacaccaccgaggccaacggacccccaaactcaatcatttangatgtacagtcacgtccgtcctcgttgggtttctacgtcgattccacgtcggtcctaccgtaagtctacggaaccacgtaccggaccctaccctaaactaacttcgtacgtcggtcctaccgacggtctacggaagacgtacggtacgttagttttactttcgtcgttcttggtttctcttacgtcggtggtaccttaagtaaaacgttagtttcggtcggtacgttcgggacggtaaccgggaccttacgttacgaacccgttacgtaacggttaccacggtacccgaacgtccgtaccgtccccgtaccgtacctaccttcccgtccgttccccg

SEQ ID NO: 175428 - DNA, 811 bp, Homo sapiens
  misc_feature: GYAE6OF02G14NT.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagccctccctgcctctggccttaaagtggggcagagtctgtatgttggtatcagttgaggccgggtccgtctccgactctagtcatgtttcaacatgataggaccggccctgacgggtacttcccgtaggtacccggtttttctcgggtcctacccgtaaaggttccggttacggggaccttacccgggcctaccgttcctaccgtatttacgttcggtccggggaaccccgtagggtacgttggtacgggaattagggtaaagggttcgtttaccttaagttttcgtacgttcgtaacggtccgttaggggttacggggaccggtccgtacccgggttcggtacccgggttccgggttccgggggccggggggttacccaccccggtagggtcccgttcggtaaccccggttcccgggtacgggttacccgaccgggtacccccggtaacggggtccccgttaccccgggtacccccccgtttccggggtacccctttaaccccgtttccccggttttaccccgggttttaccccccctaaccccccggttttaccccgttaccccggttaaccccgttttaccggtacccggtttaaccccggg

SEQ ID NO: 175429 - DNA, 677 bp, Homo sapiens
  misc_feature: GYAE6OF02HQCCL.25.55.E11.1.454.CMB.1.raw
  modified_base (238)..(238): a, c, t, g, unknown or other
  misc_feature (238)..(238): n is a, c, g, or t
tcagactgtacagtcacgaccggtgctcgatttagcactcgcacgttggggtttggggggggtctcaggaggcagcgctctcgggacgtctccaccatggcctgggctctgctgttcctcaccctcctcactcagggcacgagggtcctgggcccagtctgccctgactcagcctgcctccgtgtcgtgggactccgtggacaggtcggtccaccatcctcctgcacgtacggaaccngcccgtagactagttggtcgtacttaataactattcggtcctccgtccggtacccaaaaccaaccacccgaggaccgaaaccggaccccccaaatcatactaattttatagatcgtcagtcagtcccgccttgtggtacgtttcgtcggtctccttcgtcgtcggtcctacgtaagttcgcggtacctaacgtccgtaccctccgtacgacctacgttccggccggggtacctaccgggtacgtcgtacggaacgggtacgcggttaccttactttattacgttgacttacttacgaatacgagtaaccaacctaaccgaagtacgtcgttcggtacggtcggaacgggtacgacggtacgtccggaccgttcgtccggtacaccggtaccgacggtcctacccggtccccgttacggccttaccgtcccgttaccccg

SEQ ID NO: 175430 - DNA, 801 bp, Homo sapiens
  misc_feature: GYAE6OF02F3CLG.25.55.E11.1.454.CMB.1.raw
  modified_base (335)..(335): a, c, t, g, unknown or other
  misc_feature (335)..(335): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagccctcccctgctctggaccttaaagtggggcagaagtctgtatgttgtatcagttgaggccggcgtctccgactctagtcatgttacacatgatagcgcctcgaggtacttccgtgtaccggttttcncggctactagtcgtgggactacggctactctctacttgtcgtacgggaccaggtgtcgtaggtagtaggtaaggttcgttacgttacgtttcgtacgttcgtacgtcgttgggttacggggtaccggacccggttacccggtcgggttacccggggttccgggttttaccccggggggaccggggggtaccccggtaacccccgggtacggttacccgggttacccggggttaaccccgtttccccgggttaccggggttaccccgtaacccggggtacccccgggttaaccgggggttcccccgtttcccccggggtaccccccccgggtttacccgggtttaccccctaacccccggtttttcccggttaaccccccgtttttacccccccggaccccccgttttacccccggttaacccccgtttaccccggttttacccgggttaaccccgttaacccgggg

SEQ ID NO: 175431 - DNA, 601 bp, Homo sapiens
  misc_feature: GYAE6OF02HL9Y9.25.55.E11.1.454.CMB.1.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagactgtacagtcacgaccggtgctcgatttagcactcgcacgttgggtttgggggggtcgtcgaggaggcagcgctcgtcgggacgtcgtccaccatggcctgggctctgctgtcctctacctctcactcagggcacgaggtcctcgggccagtctgccctgactcagcctgcctccgtgtcgtcggactccgtaggactggtcgtcaccatcctctgacactcggaccaggccgtagaacgntttgggntacttataacntgtctctcgtaccaactaacggcccaggctaacggacccccaaancgaactcgatttacngatcgtcanatacgtccacctnaggctttcngtcacttctcncggactcgaagtccgtaggctaacggcctctcccgtaacacgtactccgtcgggcctaaacgcgccgtagcggtaacgngtacctagtttaacnggtttcatccttagctaaggganggtaaccncgaaactagttcgtggtgaccggtaggaccgttacgacttacgggtctaccggtcgtacaccggaacccgttgggccgtcccaccggttccgaacgtcttccgaacccgg

SEQ ID NO: 175432 - DNA, 731 bp, Homo sapiens
  misc_feature: GYAE6OF02H5OIN.25.55.E11.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (331)..(331): a, c, t, g, unknown or other
  misc_feature (331)..(331): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcgagggcacgagggtcctggcccagtctgccctgactcggctgcctccgtgctgggactccgnggacngtcgtcaccatctcctgacactggaaccnggccgtagacagttcggtntacttaataactntgtcctccgtcggtacccaacaaccacccgacggaccaaaccggaccccctaaactcactacctattttaancgtactagtacctagtaccacgtccggtccctcggtcggtacgtttccgtggtcgttacttcgtcgtcgtctaccgtagtcgtcggtacctaacgtccgtccctcccgtacgtacctacgtccggtacggcctaccggacggtctacggacggacgtacggtcctagtattacgtaactcgtacgttcctacaacgtcgttcggtaccgtacgtaacggtacgtaccggtttacggttcgggttaccggttacggaccgggttaaacgggaacccggtaaacggtaaccggttaccggtaacccggttccgggtacgggtaaccgtacccggtaacccggtacggttaccccgttaccccgggttcccccggttaaccggttcccgtaccgtttccccgg

SEQ ID NO: 175433 - DNA, 764 bp, Homo sapiens
  misc_feature: GYAE6OF02HXY58.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagccctccgtcggtgtccgtctcgttcgggccagacagccagccctcccctgctctggccttaaaggtgggacagaagtctgtatgttggtatcgtagttgaggccggtccgtctcggactcgtagtctattgttacaactatgagtacggaccggccctgacgggtcttccgttcggtaccggttttcgaggtcctaccgtaacgttcgtacgggtactaccggtcctaacttccgtactatttacgtttccggacggggtaccccgagggttacttagggtagggtaacgtagggtaaacggtttgtacctttagttttcgtagtacgtacggttccgtaggttacgggggtaccggccgtaacccgggttccgggtaccggggttacccggtttccgggggggcccggggtaccctacccccggtagggtcccgttaccgggtaacccggtttcccgggtagggtaccccgaaccggggtaccccgaacgggtcccgttcccccggacccccgttcccgggtccctaacccgtttcccgttacggttacccccctccccgtaccttcccgtaacgttccggtaacccgtaccgg

SEQ ID NO: 175434 - DNA, 845 bp, Homo sapiens
  misc_feature: GYAE6OF02ISSSR.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttcgacccagtcctccgtcggtgtccgtctcgttcgggccagacagccacgcctcccctgctctggtccttaaagtggggacagtagtctgtatggttgtatcaggttggacggccgggtccggtctccgactctagtctattcgtttacaactatgtagtacggaccggccctcgagggtactttccgtcggtaccggtttttcgtggtcctaaccgtaaggtccgttaggggtaacctaccggcctaccttctacgtacttttacgtaccggtacgggtaccccgtagggtacgttcgggtacggtaaagtacgggttaaaggtcgttttacgtttaacgtttttcgtacgggttaccgtagggttaccggttacgggtttacggggggacccggtccccggtaaccggggttcccgggttccggggttcccggggtttaccgggggggtccccggggggtaaccccaccccgggttaaggggacccggttacccgggttaccccggttcccgggtttcgggggtaacccgtaccggtaaccccggtacgggttcccgtccccgggtccccccgggttccggttaccctacccggttttcccccggtttacccggtttaccccccccgaaccccgtttcccccgtaccgtttaacccggtttccggtacccgttaaccccggg

SEQ ID NO: 175435 - DNA, 577 bp, Homo sapiens
  misc_feature: GYAE6OF02GPVMI.25.55.E11.1.454.CMB.1.raw
  modified_base (216)..(216): a, c, t, g, unknown or other
  misc_feature (216)..(216): n is a, c, g, or t
tcagactgtacagtcacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctggtaccaacaacacccaggcaaagcccccaaacttactcatttatgaggccactaacgcggccctcgaggtagtttactaatcgcttctctggcctccaagtctcggcagcacggcctccctgaccaactctcgtcgggctccgaggctgaggacgaggctagtattattactgctactctatagtcgacacagtaccaactaaacgttcccgtacgtttccggaccgttcgggaacccgtacgggtcccgtaacccggttccgtacgggtccacggtaccccgaacggaccccaacccccgtacgttcgtacccg

SEQ ID NO: 175436 - DNA, 728 bp, Homo sapiens
  misc_feature: GYAE6OF02HWV8A.25.55.E11.1.454.CMB.1.raw
tcagactgtacagtcacgaccggtgctcgatttagcactcgcacgttgggtttgggctgggcctcaggaagcagcatcggaggtgcctcagccatggcatggatccctctcttcctcggcgtccttgcttactgcacaggactttgtgacctcctatgagttgacccagcctccgtcggtgtccgtctcttcgggccagacagccacgcctccctgctcgtggccttaaaggtgggacagaagtcttagtactgttaggtatcgagttgacggccgggacgtctccgactctagtacattctttacgaactacgtagtacgtacgacggtcccgtacgagggtacttccctaggttaccggttttcggtacggtactccgtaaagtccgtaggtaccgtaaccggccgtactctactacgttaacgttcgtacgggacccaggttagtacgtagggtacgtaggtaaacgttgttcgtaacgtttcgtagtactaggtcgttacgggtacgggtacggtaccgaccggttccggtcgggttcggtaccggggccggggtaccgacccgtaacggtaccgtccggtacccgttcgggtaccggttaacgaccggtaccccgtaacgggtcccgtccggcccccgttaagggtcccttaaacccggttcccgttaacccgtttccccgtaaccctttcccgaacccgtacgttaccggttaaccctacgg

SEQ ID NO: 175437 - DNA, 695 bp, Homo sapiens
  misc_feature: GYAE6OF02GPN35.25.55.E11.1.454.CMB.1.raw
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcgttcgggccagacagccagcctcccctgcctcgtggaccttaaaggtggggcagaagtctgtatggttggtatcagttgaggccgggccgtcnccgactctagtcattgtttacaacntagatacgaccggccctacgagggtacttccgtggtaccgttttcgnggtaccttaccgtaagtcgtcgggaaccttacggccctactcgtacctatttacgttccggtacgggaccctagggtactggtaggtatagggtaaaggttgttacgttatttccgtgttaccgacggtcgttgggtacgggtacggaccgtacccggtcggtccggtttcggttccggggaccgggggtacccacccggaggtccgttacggtacccgttccggtacggtacgacccggtacccgtacgggtccctacccggtccccccgttcgggtcctaaccgttcccgttacccggttcccccacccttccgtaccctacgttaccggtacctacgg

SEQ ID NO: 175438 - DNA, 933 bp, Homo sapiens
  misc_feature: GYAE6OF02FGYQE.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaaggtgggcagaagtctgtatgttgtatcgagttgacggccgggccggtcctccgactctagtcattcgtttcaactatgatacgaccggcctacgacgggtacttccgtacggtaccggtttttcgtcggtccttaccgtaacggttccgtacgggggtaaccgttacccgggtaccctaccgttccgttactaacgttttaacgtttccgggttaccgggggtaaccccctaaggggtaacgtttcggggttacgggtaacgtagggttaaacgggtttcgtttaaccgttttaacgttttccggttaggtttaccgtaacggttccggtttacgggggttaaccggggggtaccccgggtaccccggttaaccccggggttccgggttaccccgggggtttaccggggttttaccccgggggggaccccgggggggttacccctaaacccccgggtacgggtaccccgttaaccgggttaaacccccgggttcccgggtttaacggggtaccccggtaacccgggtaccccccgggtaacggggttccccgttacccccggggtaccccccccggtttaccggggtacccccgttaaacccccgttttcccggttacccccggtttaacccccccgttaccccgtttaaccccccgttacccggttaaccccggtttaccgttaaccccggtttaacccgggg

SEQ ID NO: 175439 - DNA, 708 bp, Homo sapiens
  misc_feature: GYAE6OF02IW00N.25.55.E11.1.454.CMB.1.raw
  modified_base (148)..(148): a, c, t, g, unknown or other
  misc_feature (148)..(148): n is a, c, g, or t
  modified_base (333)..(333): a, c, t, g, unknown or other
  misc_feature (333)..(333): n is a, c, g, or t
  modified_base (579)..(579): a, c, t, g, unknown or other
  misc_feature (579)..(579): n is a, c, g, or t
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggtatttgngtacctctatgagttcgacccagcctccggtcgtcgtccgtctcgttcggccagacagccacgccctcccctgcctctggtaccttaaaggtggggacagtaacgtctgtacttgttggtatcgtaggttcggacgggcccgggtcccggtctcccgatcgttaagtcaattcgtttacaaactntaggtataacggccggaccctgtacgggtacttccgtcggttaccggtttcgtacggtccttaccgtaacggtcgtacggtaccgtaccggcctaactcgtactagtttacgtcgggtacggaacccgtagggtactggttagcgttaggaagggttcttacgttattcgttgtcgtacgtcgggtggtccgggacggccgtaccgtccggtcggttccgggtccggggtccggggaccgtaccgngtccctgggtaacccgttgggcggttccgaacggcccgaggtcccgtacccgggtccccgttccggtaccctccggttccttcccggttaccccgtccccttccgtacccgtccttacggtacgtacgg

SEQ ID NO: 175440 - DNA, 797 bp, Homo sapiens
  misc_feature: GYAE6OF02GCX2X.25.55.E11.1.454.CMB.1.raw
tcagactgtacagtcacgaccggtgctcgatttagcactcgcacgttgggtttgggctgggcctcaggaagcagcatcggaggtgcctcagccatggcatggatccctctcttcctcggcgtccttgcttactgcacaggtatttgtgaccctcctatgagttcgacccagccctccggtcggtcgtccgtctcgttcgggaccagacaggccagccctcccctgctcgcggtaccttaaaggtcggggacaaggtaacggtcttaggttagtggtttaggacttcgtaggtttggacgggtcccggggtaccgtccgtaccggacttcctaaggtccgtaattcggttttaccaaactagttacggtaataacgggacccggtacccgttacgggtacggggtaaccgtttcccggtacggttacccgggtttttccgtgggtacccttaccgaggtttacccgtaggggtaacccttaccgggcccttaacttcgtcgttaactttgttacccggtcgggacccggtaggtagttcggtagggtactagggtacggttcttacgttagtttcgtcgggtactaggtcggttcgggtcgggtaacgtccgggtaccgttcgggtccgggttaccggttccggggggccgggacctaccccggtagcccgtaccgggtcccggttcggtaccggtaccacccggaccgtagggtcccctaccggtccccgttaggcccgttacgtcccgttacccggttccccctacccgttcctaccgtacggttccgacgtccgg

SEQ ID NO: 175441 - DNA, 660 bp, Homo sapiens
  misc_feature: GYAE6OF02FH4K6.25.55.E11.1.454.CMB.1.raw
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
  modified_base (454)..(454): a, c, t, g, unknown or other
  misc_feature (454)..(454): n is a, c, g, or t
tcagactgtacagtcacgaccggtgctcgatttagcactcgcacgttgggtttgggggggtctcaggaggcagcgctctcgggacgtctccaccatggcctgggctctgctgttcctcaccctcctcactcagggcacagggtcctgggcccagtctgccgtgactcagcctgcctccgtgtctgggtctcctggacagtcgatcacctatttccngcctactggactcagcactgattgttgctaggttattactttgtctctggtaccaacaacacccaggacaaacgccccctaaattatctatttangagccactaacggcggtaccctcgaggtacgtttcctaacgtcgtcttctcgtggcctcaagttctggacacgccaccggtcccttcccaggaaccatccgtacgtcgggacctccgaggtacctggtacggaccggacgtcngttaactttacgttactcgtacttaacgtctaattacgtcgggaaccacgtaaccttaccgtaaactaaaccgttccccgttacgtttaccgggacccgttagggtacccgtacgggtaccctaaccgggttcccgtacggggttacccaccgggtacccgaacggtaccccaaaccccgtctccggtaccctacccgtttcccgg

SEQ ID NO: 175442 - DNA, 882 bp, Homo sapiens
  misc_feature: GYAE6OF02JDXEJ.25.55.E11.1.454.CMB.1.raw
tcagactgtacagtcacgaccggtgctcgatttagcactcgcacgttgggtttggggctgggcctcaggaagcagcatcgggaggtgcctcagccatggcatggatccctctcttcctctgcgtccttgcttactgcacaggatttgtgaccctctatcgagttcgaccagcctccgtcggtcgtccgtctcgtcggccagcacgccgacgtcctcccgtgtcctcgtcggtaccgttaaaaggtcggggaccgaagaaacggttctagtagttaggttaggttactacgtaggtcggacgggtccgggtccggtcctaccggtcttacgtacgtcgtacgttgttacaacgagtacgaagttacggaacccggtcccgtacggtaacggggttactttccggtacggtttaacccggggtttttcgtaccgggtacccttaccggtaaaacggttccgggttaaggggtaacccgttaacccgggtccctaacgttaccgtacgttaacgttttacggttaccggggtaaccggggtaacccgaaggggttacggttaagggttcggtaaggttaacgggtaaggggtttacgttacgtttaacgtttacgttacggttacgtacggtacggtttaggggtaccggggtaccggtaccggtcccggttaccgggtccgggtttaccgggtccggggtaccgggggtaccctaaccccgggtacggtccggttaaccggtccccgggttaccggtaaccgggtaccgtacccgtacccgggtaaccggtacccggtccccggtaccccgtcggtacccgtaccccgttccgttaccccgggttccccttcccggtacccgttaccgtccgtacggttaaccg

SEQ ID NO: 175443 - DNA, 731 bp, Homo sapiens
  misc_feature: GYAE6OF02HJ6IO.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttcgacccagcctccgttcggtgtcccgtctcgttcgggccagacagccagccctccctgctctggccttaaaggtgggcagagtctgtatgttgtatcgagtgacggcgggccgtctccggaatcgtagtcattcgttactaacattgagtaagaccggacctcgaggtacttaccgtgttaccggttttctcggccttcaacgtcgtacgggtacctacggtccctaactctcgtaactttacgtcggtacggaacccgtaggacgttggtacggagtaggtaagggtgttacttagtttcgtgttcgtaagtcgttcgggtacgggtaccgtacgtccggttacggtccggggttccggtttaccggggcccgggggtaccgtacccggtaacgtccgggtacggttacccggtacccgggttcgggtacccgtacccggaaccccggtacgggacccggttaccccggtccccccggttacggtacccgtacccgtttacccgttccccggtttccccctacccccgttcccgttaccgttacccgttaccggtaccggttacccgg

SEQ ID NO: 175444 - DNA, 839 bp, Homo sapiens
  misc_feature: GYAE6OF02JC0TZ.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtggtgtccgtctcgttcgggccagacacgccagtccctcccctgcctcgtcggtacctttaaaggtgggggacaggtaacgttcgtaggtattcggttggtattcgaaggtttcggacgggtcccgggtccggttaccgtcccgaacgttccttaacggtcctaagttcgttttacaaacgagttcgagtacggaccggcccgtacgaacggggtactttcccgtcggttacccgggtttttctcgggtaccttacgtaacggttccgttacggggtaccttaccgggcctaccgtttaccgttaccttaacgttttacgtttacccgggtccggggtaacccccgtaggggtaacgtttcggggtacgggtaagttacggggtaaacgggtttcggtttacgtttagtttaccgttacgttcgtaacgtcgttacgggttcgggacccggtccgtaccggtccggttccgggttacggttccggggccggggtacccgacccggtacggtccgtacgggttacccgggtacggtccggggtaccgaacgggtccccgtaacggtccgttacccggtccccccggttcgggtaccctaccggtttcccgttaccggttcccccgttcccggttaccccttcgacccggttacggttccgtacgg

SEQ ID NO: 175445 - DNA, 819 bp, Homo sapiens
  misc_feature: GYAE6OF02I6IAM.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtgacctcctatgagttgacccagcctccgtcggtgtccgtctcgttcgggccagacagccagcctcccctgctctggaccttaaaggtggggacaggaacgtctgtattggttgtatcgtagttggaggccgggccgtctccgtacttctagtcattgtttacaactatgagtaggaccggtcctacgagggtaccttccgtcggttaccggttttcgtggtcctaccgtaacggttctagggggtacctaccggcctacgttccttacgtacgttttaacgttcccgggtaacggggtaaccccgtagggtacgttggggttacgggtaagttacggttaaaggggttgtttaccgtttaacgttttcgttacggttacgtacggtcggttacggggttacgggtaccggtaccgtacccgggttcggtccggggttccgggttccgggggcccgggggtacccgtaccggtaccgggttaccgttaccgggtacccggtttccgggttaccggggttaccgaacccgggtaccccgggtaacgggtcccgttaccccgggtacccccggttaccgggttacccgttaacccggttcccgtttacccggtttccccccggtccccgtttaccccgttacccgtcccgttttaaccggtaccgttaacccggg

SEQ ID NO: 175446 - DNA, 715 bp, Homo sapiens
  misc_feature: GYAE6OF02IJGUI.25.55.E11.1.454.CMB.1.raw
  modified_base (146)..(146): a, c, t, g, unknown or other
  misc_feature (146)..(146): n is a, c, g, or t
  modified_base (171)..(171): a, c, t, g, unknown or other
  misc_feature (171)..(171): n is a, c, g, or t
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
  modified_base (523)..(523): a, c, t, g, unknown or other
  misc_feature (523)..(523): n is a, c, g, or t
tcagactgtacagtcacgaccggtgctcgatttagcactcgcacggttggggtttgggggctgggcctcaggaagcagcatcgggaggtgcctcagccatggcatggatccctctcttcctcggcgtccttgcttactgcacagtnttgtgacctctagtgagttcgaccngtcctccgtggtcgtccgtctcgttcgggcctaggacagtccacgtccctaccccgntcgtcgtcggaccttaaggtggggacagtaagtcgtgtattgtggtatcgagttcggagggtccggtccgtgtccgatcctaggtctagttcgttacgaanacgtgtacgtaacggccgtaccctgggaacggttcgttccgtaggttaccgtttgcgtaccttaccggtaagttccggacgggtaaccttaccggacctacttcgtacgttagtttaccgttacggaaccggggcctaaaggtcgtcggtacggtacgttagggtacgttcggttattacggttcgtcggtacnggttacgtcgggggtacgtaccgggacgttcccggtacgggtcgtccgggttcgggcggggaccttaccggctccggtccggacgttccgtggaacccggtcgtaccggaccgttccgtacccggtccccgtacggttcctaccgtccggttaccctccccggtacctccgttacggccgtacctggttacg

SEQ ID NO: 175447 - DNA, 692 bp, Homo sapiens
  misc_feature: GYAE6OF02INLUB.25.55.E11.1.454.CMB.1.raw
tcagactgtacagtcacgaccggtgctcgatttagcactcgcacgttgggtttggggggggtctcaggaggcagcgctctcgggacgtctccaccatggcctgggctctgctgttcctcacccctcctcactcagggcacgagggtcctgggcccagtctgcccctgactcagccctgcctcgtgtcgtgggactccgtggactagtcggtccacctattcctcctgccacgtcggaaccagcccgtagactagttggcgtcttaataactatcgtcctccgtcggtacccaacaaccacccgacggaccgaaccggacccccctaaactacctactacctaattttacgtagtatcgttcacgtcctacgtcccggtacccttgttacggttacgtttcggtcggttcgtccgtttctccggttcggtacctaccgtaagttccgtacggacctaaccgttccggtaccctcccgtaccgaccgtcgtccggtcgggtcctcgtacggcgtaggacggtacgacgtacttacgttattacgtcgtacttattacctagtaccgaagacctaacctaaccgaactcggtcgttgggtcgtcgggacggttaacggaaccgtacgttaccggccgttcgtcgacgaccgtaccgcgtccgtcccgtacccgtcggtactccgttacctccccg

SEQ ID NO: 175448 - DNA, 729 bp, Homo sapiens
  misc_feature: GYAE6OF02ISMRF.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctctcgcgcgtcctgcttactgcacgagtatttgcgtacctcctagtgtagttccgacccacgtccctccgtcggtcgtccgtctcgtcggcagacacgccacgccctcccgtgctcgtacggtaccgttaaaggcgggacaagtaacgtctagtagttgttagtatgtaggttggacgggccggtccggtctaccgtactcgtacgtctagtttacgttacaacgtacgtagtaacgtacggacccgtcccgtacggacggttaccttccgttacggttaccggtttcgacggtctaccgtagtccgtacggaaccgtaccgacctacgttctacgtacttacgttcggtacggaccgtagggtattcggtaggtaacgtaggtaagttcgttacttacttcggtgtcgtacggtcggttgggtacgggaccgtccgtaccggtccggtcggtccgggtccgggcgggtaccaccggagtccgaccgttaccggtcggtcggaccgtaccgaacccgtacggtccctccccgggtaccccgttaccggtccgttaccgttaccccgttcccgtacccccgtacccgttacccgtcctaaccgttccgtaaggttcccgg

SEQ ID NO: 175449 - DNA, 740 bp, Homo sapiens
  misc_feature: GYAE6OF02G93V0.25.55.E11.1.454.CMB.1.raw
  modified_base (202)..(202): a, c, t, g, unknown or other
  misc_feature (202)..(202): n is a, c, g, or t
tcagactgtacagtcacgaccggtgctcgatttagcactcgcacgttgggtttgggggggtctcaggaggcagcgctctcgggacgtctccaccgatggcctgggcttcgtgctgttcctcaccctcctcacctcagggtcacgagggtcctgggccctagtctgaccctgactcagtcctgcctcgtgtctgggacctcgnggacagtcggtacacctatctcctgcattcggaacagtccgtgacctagttggtgtctttaatactatgtaccgttcctaggtaccccaaataccacccgtaggacctaaccggacccccaaatcgtaattaccgtatttatcgtattcgtactagtacacgtccgcccgtagtcggttacttccgtaggtctcgttcctacgtcggtcctacgttacgtcgtacgtacgtaccgtccggtcctacccggtagtacccgtaaccggttccggtccggggtaccttccggacgggtacccggttagggaaccgggtaccgggtaacttacgttaaccgtttacgtttacgtacgtacgttatttacggtaacacggtacgtacgtaaccctaccgttaacaccgggtttctacggggtttaccggtcggaacggggtacctaacgtcgggttaaccgttacccgggtccgtacggtacccgaacgtaacccggccgtaccggtaccccgttccgaaccggcttaccggtcccttcccgg

SEQ ID NO: 175450 - DNA, 818 bp, Homo sapiens
  misc_feature: GYAE6OF02J2GWZ.25.55.E11.1.454.CMB.1.raw
  modified_base (117)..(117): a, c, t, g, unknown or other
  misc_feature (117)..(117): n is a, c, g, or t
  modified_base (173)..(173): a, c, t, g, unknown or other
  misc_feature (173)..(173): n is a, c, g, or t
  modified_base (670)..(670): a, c, t, g, unknown or other
  misc_feature (670)..(670): n is a, c, g, or t
  modified_base (760)..(760): a, c, t, g, unknown or other
  misc_feature (760)..(760): n is a, c, g, or t
tcagactgtacagtcacgaccggtgctcgatttagcactcgcacgttgggtttggggctgggcctcaggaagcagcatcggaggtgcctcagccatggcatggatccctctcttccncggcgtccttgcttactgcacaggatttgtcgacctcctagtgtagttcgaacccngccctccgtcggtgtcccggtctcgttccgggccagacagcccaggtcccctcccctgtcctcgttacggacccgttaaaaggtcgggggtccaaggtaagttccggttagttagttacggtttggggttaacttccgtaagggttgaccggggtcccgggtccgggtaccgtcccgggtaactcgttacgtctacgttacggtttacaaactcgtaagtacgacggtaaccggtccgtacgtacgggtacttccgtacggtttaccggttttcgtcgccgttaccgtaacgtcggttaaccgaccgttacggacccttctctataacgtttcgttcggtaccgggtaccgtaggtacgttggtaaggtagttccgggtaaaggtttcgtccgtttaaattttcgttaccgaaggttctccgggttagggttaaccgggacggccgttaccgggttcgggaccggttttcgggtccggggggtacccggggttaccncccggggttaaccgtccgtaccggttaacccgggtccggtttaggccggacccgtcggtaccggtcccgtccggtccccgtttacccggntacccggttcgttaccgtccccgtacccgtcctttacgcccgttaagtccttaaccgg

SEQ ID NO: 175451 - DNA, 721 bp, Homo sapiens
  misc_feature: GYAE6OF02GFP4M.25.55.E11.1.454.CMB.1.raw
  modified_base (118)..(118): a, c, t, g, unknown or other
  misc_feature (118)..(118): n is a, c, g, or t
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (482)..(482): a, c, t, g, unknown or other
  misc_feature (482)..(482): n is a, c, g, or t
tcagactgtacagtcacgaccggtgctcgatttagcactcgcacgttggggtttggggctgggcctcaggaagcagcatcggaggtgcctcagccatggcatggatccctctcttccncggctccttgcttactgacacgtaggtattttgtcgtacctcctaagtgtagttcgacccagtccctccgtcggtcgtccgtctcgtcgggccagacacgccacgcccttcccngccttacgtcggtacctttaaagggngggacaaggaacgttcttagtacgttggttaggtacttgtaagttggaccggtcccgggccgttcctccgtacttctagtcctagtttcgtacactagtgacgtacgaccggtccgtaggacggtcttcccgttaggttccggtttcgacgtcctaccggtaaggtccgtacgggaccttcggacctagttcctcttaagtttaccgtcgggtccgggtaaccngggtagttcggtaggtagtagggttaagttgtttacgtttctttacggtgttacggtcgttcggtacggggttcgggacccgtcggtaccgggttcggtccggttccgggtccgggtacggcctaccgcgtcgtcggtaccgtcgtcgaccgtcgccgacgtccctacccggtcccggtaccgtctcccttcccgttacccgtcccgtccgttcccgtactaccggttcgaccgtccgg

SEQ ID NO: 175452 - DNA, 891 bp, Homo sapiens
  misc_feature: GYAE6OF02JH3O1.25.55.E11.1.454.CMB.1.raw
tcagactgtacagtcacgaccggtgctcgatttagcactcgcacgttgggtttggggctgggcctcaggaagcagcatcggaggtgcctcagccatggcatggactccctctcttccgtcggccgttccttgtccttactcgcacaggtatttgtcgtacccttccgtatggtagtttcgacccacgtcccttccggtcgggttcgtcccgttcttcttaccgggccacgacacgccgacgtcccctcccctgcctcgtacggtaccttaaaggtcggggacaaggtacgttctagtacgtggttgtatcgtcgttagggacggtcccgggtaccgttctaccgtacttcgtagtcctagttcggttacaaacgtagtcggtaccgtacggtaccggtaccgtacggaacgggttaccttttacccggtccgggtttaccggttttcggtaccgggtacctaccggtaacggtttccggtacggggtacctaacccgggtaccctaccgttcgttaccttacgtttacggttcccgggtaccggtacccggaggtttacgttacggtagggtacgtaagggttaacgggttcttacgtttaagtttcggtccttacggtacggacggtttacggggtaccgggtaccggtacccggtcccgggttaccgttccggggttacccgggtcccgggggtacccgggtaccctaacccgggtaccgggtaccggtacccgggttacccggttaaccgggttccggaacccggtaccggttaaccccgggtcggtccccgttccccgggtcccggttaacccgttccgtaacccgtttccccgtaccccgttccccccggtccttaccctaccggtacccgttagtacccgtacgg

SEQ ID NO: 175453 - DNA, 733 bp, Homo sapiens
  misc_feature: GYAE6OF02IMAIX.25.55.E11.1.454.CMB.1.raw
  modified_base (179)..(179): a, c, t, g, unknown or other
  misc_feature (179)..(179): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
  modified_base (353)..(353): a, c, t, g, unknown or other
  misc_feature (353)..(353): n is a, c, g, or t
  modified_base (720)..(720): a, c, t, g, unknown or other
  misc_feature (720)..(720): n is a, c, g, or t
tcagactgtacagtcacgaccggtgctcgattttagcactcgcacggttggggtttggggggggtctcaggaggcagcgctcgtcgggacgtctccaccatggcctgggctctagcctgttcctcaccctcctcactcgagggcacgaggtcctggcccagtctacgccctgactacgngccttggcctccgtagtctagggctcctggacngttcggcaaccatcctcctgcacgtacggaaaccgngtaccgtgacctagttggtctacttaataacgtnttacgtctccgtacggtaaccaacaaccaccgagaccgaaaccggaccccaaacgtcatacttaagttacngactagtacagtccacgtccgaccttgtaggtcttgtggtctctacgtgtacgtctacgtaattcgtacggtacaacccgttccggacccttccgtaacgtaccgtacgtaccggtccgggacctaccggtaggaccgtagggtaaaccggacgggttaaccgtaccgttttaaattacgttaacttacggtaaacttttactaaccgtaacgaacgtaaacgaccgtaaccaaacgtaacggttcgttaacggttcggtaccgggtaaccggtcgggtaaaccgtaaccgttaggttaacccggtaccggttaaccgtcggtaacgaaccgaccgtacgtaccctcccggtacccgtcggtaaccncgttaccgtcccg

SEQ ID NO: 175454 - DNA, 652 bp, Homo sapiens
  misc_feature: GYAE6OF02IFTQV.25.55.E11.1.454.CMB.1.raw
  modified_base (245)..(245): a, c, t, g, unknown or other
  misc_feature (245)..(245): n is a, c, g, or t
  modified_base (512)..(512): a, c, t, g, unknown or other
  misc_feature (512)..(512): n is a, c, g, or t
tcagactgtacagtcacgaccggtgctcgatttagcactcgcacgttgggtttggggggggtctcaggaggcagcgctctcgggacgtctccaccatggcctgggctctgctgttcctcaccctcctcactcagggcacgagggtcctgggcccagtctgccctgactcagccctgcccttccggtgtctggggacctccgtaggacaggttccggtcaaccatcctcctgcacgtacggaaccngccgtgactgtttgggtacttactttaaactaacgttagttcgtccttccgtccggtacccaaaaccgaaccaacccccgaggaacccgaaaccggacccccctaaactctaatcttaatttactgtactgtacacgtcacgtccggccctgtagttcgtttcgtggtctcttctgtcgctcacgtcgtgcacgtcgcctaccgctactcgtccggtcggcctaccgaggcgagggagaccgtacggtactttaacgttatttaagngttaccttattacaagtacgagaactaaccacgtaactggtcgtaggtcggtcgggacgtaggtacgtacgtccggtaccgtcgaccggacaccgaccgtacgtccgtccgtaccccgtcgtactcccgttccgtccccg

SEQ ID NO: 175455 - DNA, 730 bp, Homo sapiens
  misc_feature: GYAE6OF02GJHRI.25.55.E11.1.454.CMB.1.raw
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (336)..(336): a, c, t, g, unknown or other
  misc_feature (336)..(336): n is a, c, g, or t
tcagactgtacagtcacgaccggtgctcgatttagcactcgcacgttgggtttggggctgggcctcaggaagcgagcatcggaggtgcctcagccatggcatggatccctctcttcctcggcgttccttgcttactcgacacaggtattttggtacgacctcctatggtagttcggacccagtcctccggtcggtcgtccgtctcgttcgggccagcacgcncgcctccctgctctcggtccttaaaggngggactagagtctgtnttggttagtatcgtagttcggacgggccggtccgttctccgtactgtaacgtctattcgtttacaacgtntacgtagtaccggccgtcccgtagtacggtacttccgtacggttccgttttcggcggtccttaccggagtccggtaacggtacctaccgggtcctacttccgtacgtacgttttcgtccggtaacgggtaccccgtagggttaacgtcgggttaggtacgtacgggtaacgttcgtttacgtttacggtttccgttggttacctacggtcggtttaggggttccgggacggtccgttaccggtcggttaccgggttccgggttccgggaccgggtcccgtacgcgtcgtaccgtccgtcgtacggtcgacgccgtacgccgtccgtcccgtcgtccgtccgttaccgtcccgttaccccgtcttacccgtaccgtccggttacgtaccgttcgg

SEQ ID NO: 175456 - DNA, 680 bp, Homo sapiens
  misc_feature: GYAE6OF02H6QJN.25.55.E11.1.454.CMB.1.raw
  modified_base (226)..(226): a, c, t, g, unknown or other
  misc_feature (226)..(226): n is a, c, g, or t
  modified_base (272)..(272): a, c, t, g, unknown or other
  misc_feature (272)..(272): n is a, c, g, or t
  modified_base (508)..(508): a, c, t, g, unknown or other
  misc_feature (508)..(508): n is a, c, g, or t
tcagactgtacagtcacgaccggtgctcgatttagcactcgcacgttgggtttggggctgggcctcaggaagcagcatcggaggtgcctcagccatggcatggatccctctcttccgtcggcgttccttgcttactgcacaggtatttgtcgacctcctagtgagttcgacccagccctccgtcggtgtcccgtctcgttcggccagacacgccacgccctccccngtctcgtggtaccttaaggtgggacagaacgtctgtatgttaggtntcgagtggacggccgggccgtctcgtctcgagtctacgttgttacaatctagactacggccggtccgtacgaaggtcttccgtacgtccgtttcgcggtctacgagtccgtaggacctacggctactctactattcgtcgtaccggaccagggtgtggtggtaacgttaggtaacgggttcttactttacgtttcgtacgtaacgtcggtcgaacgggttcggggaccccggttanacccgggttggtacgggttccgggttaccgggggccgggtaacccctacgttcgggcctttacggggtaccccttcgggacggttaccacccggtaccgtacggcccgtcccgtcccgttacggctacctttcggccccttaccgcccgtaccttcgacgtactaccgtcgg

SEQ ID NO: 175457 - DNA, 958 bp, Homo sapiens
  misc_feature: GYAE6OF02IPVZ5.25.55.E11.1.454.CMB.1.raw
tcagactgtacagtcacgaccggtgctcgatttagcactcgcacgttgggtttggggctgggcctcaggaagcagcatcggaggtgcctcagccatggcatggatccctctcttcctcggcgtccttgcttactgcacaggatttgtcgacctcctaatgagttcgacccagcctccgtcggtcgtccgtctccgttcggccagacacgccacgccctccccgtgcctcgtcggacctttaaaggtcggggacaaggtacgttcgtagttagtggttggttatcgtagttcggacgggtcccggggtccggttccgtcccgtaccttccgttacggtctacgttcggtttacctaacctagttacggtaacgtaaccggtacccggtaccccgtacggtaacgggttaaccgtttacccgtttaccggtacccggggttttttttttttcccggacgggttccccgttaaccggtaaaccggtttccggttaaccggggtaacccgttacccggggtacccttaacccgtttaccgttaaccgttacgttttaaccggttttaccggggttaaccccggggttaacccggtaccggggttacggtttaacgggttacggggtaacgggtttaacggggtaaacggggtttcggttttaaccggttttaaccgtttttccggtttaggttaccggttaaccggttccggttaccggggttaccgggggtacccgggtaacccggtacccgggtttcccgggtccggggttaacccgggttcccgggggtacccgggggtacccgtaccccggtccggtaccggtccggttacccggttcccgggtcggtaccgtacccggacccgtacgtacccggttccccgccccggtccgtcgtaacccgttccgttcccgttaccccgtacccgttccctaccgtccgttccgtaccgttaccgg

SEQ ID NO: 175458 - DNA, 726 bp, Homo sapiens
  misc_feature: GYAE6OF02I0AAQ.25.55.E11.1.454.CMB.1.raw
tcagactgtacagtcacgaccggtgctcgatttagcactcgcacgttgggtttgggggctgggcctcagggaagcagcatcgggaggtgcctcagccatggcatggatccctctcttcctcggcgtccttgcttactgcacaggatttgtgacctcctatgtagttgacccagccctccggtcggttgtcccgtcttcgttcgggaccagcagccgagtccctccctgctctcggtaccttaaaggtcggggctaagaacgttcgtagtagttcgttaggtatcaggttcgacgggccgggccggtctccggtaactcgtacgtctattgttacaactatagtacgtacggtaccggaccctacgacgggtacttccgttcgtaccgggttttctggctcctaagtcgtacggacgtacgcctacttctactacttacgttcggtacggaaccgcggtacgtcggtagagtacggtagggttacgtcttagttcgtacgtcgtaacgccggttgggtacgggtaccgggtaacggacccgttccggttaccggggttccgttcggggaccgggggtaccctaccggtacgtccggtacggtcccggtaccggttacgggtaccgtacgacccgggtaacgtccgtacccgcccccgttccgggttacctaccgtacccgttcccgtaccccgtccccgttacctcccgtactacggtacgtaacgg

SEQ ID NO: 175459 - DNA, 179 bp, Homo sapiens
  misc_feature: GYAE6OF01DF5RG.36.37.D04.1.454.CMB.1.raw
  modified_base (176)..(179): a, c, t, g, unknown or other
  misc_feature (176)..(179): n is a, c, g, or t
tcagtacgctgtctcacgaccggtgctcgatttagtagcatactgttgggtttgggcccatcggtcttcccctggcaccctcctccaagagcacctctggggcacagcggccctgggctgcctggtcaaggactacttccagacagcgtactgagcgggctggcaaggcgcatagnnnn

SEQ ID NO: 175460 - DNA, 183 bp, Homo sapiens
  misc_feature: GYAE6OF01C1VF6.36.37.D04.1.454.CMB.1.raw
  modified_base (178)..(183): a, c, t, g, unknown or other
  misc_feature (178)..(183): n is a, c, g, or t
tcagtacgctgtctcacgaccggtgctcgatttagtagcatactgttgggtttgggcccatcggtcttccccctggcaccctcctccaagagcacctctgggggcacagcggccctgggctgcctggtcaaggactacttccagacagcgtactgagcgggctggcaaggcgcatagnnnnnn

SEQ ID NO: 175461 - DNA, 328 bp, Homo sapiens
  misc_feature: GYAE6OF01EC83G.36.37.D04.1.454.CMB.1.raw
  modified_base (320)..(328): a, c, t, g, unknown or other
  misc_feature (320)..(328): n is a, c, g, or t
tcagtacgctgtctcacgaccggtgctcgatttagtagcatactgttgggtttgggtgatcaggactcctcagttcaccttctcacaatgaggctccctgctcagctcctggggctgctaatgctctgggtctctggatccagaggggatattgtgatgactcagtctcccctctccctgcccgtcacccctggagagccggcctccatctcctgcaggtgtagtcagagcctcctgacaaagaactgtggctgcaccatctgtcttcatccttcccgcatctgaagcagcgtactgagcgggctggcaaggcgcatagnnnnnnnnn

SEQ ID NO: 175462 - DNA, 480 bp, Homo sapiens
  misc_feature: GYAE6OF01EYSYT.36.37.D04.1.454.CMB.1.raw
  modified_base (337)..(337): a, c, t, g, unknown or other
  misc_feature (337)..(337): n is a, c, g, or t
  modified_base (473)..(480): a, c, t, g, unknown or other
  misc_feature (473)..(480): n is a, c, g, or t
tcagtacgctgtctcacgaccggtgctcgatttagtagcatactgttgggtttgggattcacgttgcagatgtaggtctgggtgcgacaggctcctggaaaagggcttgagtggatgggaggttttgatcctgcagatgatgaaacaatctacgcacagaagttccagggcagagtcaccatgatcgaggacacatctacagacacaggctacatggagatgagcagcctgagatctgaggacacggccgtgtattactgtgcaacagctatgattatgtttggggtagctaatgactttgactactggggccagggaacctggtcacgtctcctcngcctccaccaagggcccatcggtcttcccctggcaccctcctccagacgcacctctggggccacgagccggccctgggctcgcctgtcaaggactactccagacagcgtactgagcgggctggcgaggcgcatagnnnnnnnn

SEQ ID NO: 175463 - DNA, 669 bp, Homo sapiens
  misc_feature: GYAE6OF01DGSFM.36.37.D04.1.454.CMB.1.raw
  modified_base (200)..(200): a, c, t, g, unknown or other
  misc_feature (200)..(200): n is a, c, g, or t
tcagtacgctgtctcacgaccggtgctcgatttagtagcatactgttgggttgggggagctgctcagttaggacccagagggaaccatggaaaccccagcgcagcttctcttcctcctgctactctggctcccagataccaccggagaaattgtgttgacgcagtctccaggcaccctgtctttgtctccgaggggaaangcccaccctctcctgcagggccagtcagagtgtagcagcagctacttagcctggtaccagcaagaacctggccaggcctcccagacctcctcatctagtggtgcactccagcgaacgggcccacgtggccactccccaagaccgtaggtttcaggtcgggacaggttcggggtcgtaggggacctaggtactttccgaacttcctccaaccctattccgaaggtcgaacggtaccgtgggacgtacccgttagtaaacgttagttttcggcgtaagttgttaactttacgttcgtactagtaactaagtagtacggtaaccttacccgttacccgggtaaccggtttaccgggacccgtaaacgggaccgtaaacgggtacggtaaaacgtaaccggtaaaaccggtaacgtaggttcggaccgtaggacccgtaaccgtaacgttccgttacggttcttccgtacccg

SEQ ID NO: 175464 - DNA, 325 bp, Homo sapiens
  misc_feature: GYAE6OF01ASUY1.36.37.D04.1.454.CMB.1.raw
  modified_base (320)..(325): a, c, t, g, unknown or other
  misc_feature (320)..(325): n is a, c, g, or t
tcagtacgctgtctcacgaccggtgctcgatttagtagcatactgttgggtttgggtgatcaggactcctcagttcaccttctcacaatgaggctccctgctcagctcctggggctgctaatgctctgggtctctggatccagaggggatattgtgatgactcagtctcccctctccctgcccgtcacccctggagagccggcctccatctcctgcaggtgtagtcagagcctcctgacaaagactgtggctgcaccatctgtcttcatccttcccgcatctgaagacagcgtactgagcgggctggcaaggcgcatagnnnnnn

SEQ ID NO: 175465 - DNA, 334 bp, Homo sapiens
  misc_feature: GYAE6OF01AK4KF.36.37.D04.1.454.CMB.1.raw
  modified_base (328)..(334): a, c, t, g, unknown or other
  misc_feature (328)..(334): n is a, c, g, or t
tcagtacgctgtctcacgaccggtgctcgatttagtagcatactgttgggtttgggtgatcaggactcctcagttcaccttctcacaatgaggctccctgctcagctcctggggctgctaatgctctgggtctctggatccagaggggatattgtgatgactcagtctcccctctccctgcccgtcaccccctggagagccggcctccatcctcctgcaggtgtagtcagagccctcctgacaaagaactgtggctgcacatctgtctcatccttcccgcatctagaagacagcgtactggagcgggctggaccaaggcgacagtagnnnnnnn

SEQ ID NO: 175466 - DNA, 737 bp, Homo sapiens
  misc_feature: GYAE6OF01AMTWZ.36.37.D04.1.454.CMB.1.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
tcagtacgctgtctcacgaccggtgctcgatttagtagcatactgttgggttgggggaagctgctcagttaggacccagagggaaccatggaaaccccagcgcagcttctcttcctcctgctactctggctcccagataccaccggagaaattgtgttgacgcagtctccaggcaccctgtctttgctccaggggaanagccaccctctcctgcagggccagtcagagtgttagcagcagctactagcctggtaccagcagaacctggccaggcctccgagacctcctcatcgtatggtncatccaggcagggccacgtggcactccccgaagactagggttcaggtcgggacctaggtggggtctaggggatacggacctttcaacctctaccactactcagcgaagacgtcgggacgtacctaggtaaacgtagttttacggaccgtagggttacgttaacgttttacgtacggttactaacggtaaccgtaaacttaacggttacggtaacccgtttaaccccggttacccccggggttaacggtttacccggggaaccccggttaaaccgggggtaaaccccggtaaagggggttaaaccggggtaaaaaccggtttaaacccggtaaaaaccgggttaaacccggttacgggttacccggggttactttaccgggaaccctaacccggttaacgttaccgggtttaccgttaaacgtttcccgttaacccgg

SEQ ID NO: 175467 - DNA, 856 bp, Homo sapiens
  misc_feature: GYAE6OF01BC0IT.36.37.D04.1.454.CMB.1.raw
  modified_base (200)..(200): a, c, t, g, unknown or other
  misc_feature (200)..(200): n is a, c, g, or t
tcagtacgctgtctcacgaccggtgctcgatttagtagcatactgttgggttgggggagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcgaggccagtcagagtgtagcagcagctacttagcctggtaccagcaagaaacctggaccaggcctcccgagacctcctacatcgtagtggtcgacactccgaagccgacgggccctacgtcggacctactaccccgaaggtaaccgtacgggtttacaacggttcgggaccgtaaggggttcgggggttaccgttaaggggggaaccctaacgggttaacccttttacccgaaccgtttacccgtaccgtaaacccgtaacgttacccgaacgtaacccgtaacggtaacccggttacggggaaccgtaacccggttaagggtaaaacggttttacggtttttacgaaccggtttaacgggtttacgttttaaccgttttaaccgttcggttaacccgtaacgggtaacttaaaacgtttaacggttaccggttaaaacccgtttaacccccggttaccccgggttaaacgggtttccccgggaaccgggtaaaaccggggtaaccgttaaaacggggtaaccggttaaaaaaccgttaacccggaaaaacccggttaaggtacgggttaccgggtaccgttaaccggacccgtaaacccgttaacgttcgtttaaccgtttccgttaccgttaacccg

SEQ ID NO: 175468 - DNA, 749 bp, Homo sapiens
  misc_feature: GYAE6OF01BKA2B.36.37.D04.1.454.CMB.1.raw
  modified_base (197)..(197): a, c, t, g, unknown or other
  misc_feature (197)..(197): n is a, c, g, or t
tcagtacgctgtctcacgaccggtgctcgatttagtagcatactgttgggttgggggagctgctcagttaggacccagagggaaccatggaaccccagcgcagcttctcttcctctgctactctggctcccagactaccaccggagaattggtgttgacgcagtctccaggcaccctgtctttgtctccgagggaancgccacctctcctcgcgacgggccagtcagacgtgttacgctagcgtagcgttacgtacgccgtacggtaccagaccaagtaaccgtcggaccgacggccctccgaacgccttacctactacttcgtaacgtcggtacgcctaacgtccgtaacggccgacgggtacctacggtcggacccaccgtaccaacgggtactacggttcgtaaggtcgggacgtgggttcgggttacggacgggtactaggttaccttaccgacgttacctactaacccgtacttaacggacggtaccgtacggtaaccggtacggggtaacgtcccggtaaggttaaccggttacgttttaccgggagttacggtttacgttacctttccggtaagtaacgtaccgtaacgtaattaccggttaccggtaaccgttaccccggttacccgggtacgttacccgggtaacggaaacggaccgttaaagggtaaccggtaactaaacccggtaacgtaacgtcggtcgactagggacctacgttacgtctcggttactcgttaccg

SEQ ID NO: 175469 - DNA, 326 bp, Homo sapiens
  misc_feature: GYAE6OF02FZNIR.36.37.D04.1.454.CMB.1.raw
  modified_base (321)..(326): a, c, t, g, unknown or other
  misc_feature (321)..(326): n is a, c, g, or t
tcagtacgctgtctcacgaccggtgctcgatttagtagcatactgttgggtttgggtgatcaggactcctcagttcaccttctcacaatgaggctccctgctcagctcctgggctgctaatgctctgggtctctggatccagaggggatattgtgatgactcagtctcccctctccctgcccgtcacccctggagagccggcctccactctcctcgcaggtgtagtcagagcctcctgcaagaactgtggctgcaccatctgtcttcatcttcccgcccatctgaagacagcgtactgagcgggctggcaaggcgcatagnnnnnn

SEQ ID NO: 175470 - DNA, 182 bp, Homo sapiens
  misc_feature: GYAE6OF02IOPVU.36.37.D04.1.454.CMB.1.raw
  modified_base (178)..(182): a, c, t, g, unknown or other
  misc_feature (178)..(182): n is a, c, g, or t
tcagtacgctgtctcacgaccggtgctcgatttagtagcatactgttgggtttgggcccatcggtcttccccctggcaccctcctccaagagcacctctgggggcacagcggccctgggctgcctggtcaaggactacttccagacagcgtactgagcgggctggcaaggcgcatagnnnnn

SEQ ID NO: 175471 - DNA, 178 bp, Homo sapiens
  misc_feature: GYAE6OF02I52HN.36.37.D04.1.454.CMB.1.raw
  modified_base (177)..(178): a, c, t, g, unknown or other
  misc_feature (177)..(178): n is a, c, g, or t
tcagtacgctgtctcacgaccggtgctcgatttagtagcatactgttgggtttgggcccatcggtcttccccctggcaccctcctccaagagcacctctggggcacagcggccctgggctgcctggtcaaggactacttccagacagcgtactgagcgggctggcaaggcgcatagnn

SEQ ID NO: 175472 - DNA, 247 bp, Homo sapiens
  misc_feature: GYAE6OF02G0VMI.36.37.D04.1.454.CMB.1.raw
  modified_base (246)..(247): a, c, t, g, unknown or other
  misc_feature (246)..(247): n is a, c, g, or t
tcagtacgctgtctcacgaccggtgctcgatttagtagcatactgttgggtttggggtagctaatgactttgactactggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnn

SEQ ID NO: 175473 - DNA, 688 bp, Homo sapiens
  misc_feature: GYAE6OF02I29O1.36.37.D04.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagtacgctgtctcacgaccggtgctcgatttagtagcatactgttgggttgggggagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccaccctctcctgcagggccagtcagagtgttagcagcagctactagcctggtaccagcagaaacctggccaggcctcccagactcctcatctatggtncatccgagcgacgggccacgtcgggccactcccgaagaccgtagggtttccaaggttgggaccagggttcggggtccgtggggaaccaggtacccttcaaccgttctaccaaccctataccgaacgtccaaggtaaccgtcgggaacgtcccgtaaggtaaacgttacgtttttcggaccgttaaggtttcgtttaacgttttaaccgtcggttaccaaggtacttaaaattacgttacgtaacgtttaaccccggtccccggggtaacgtttccggaacccggtaaagggaacccggtaagggttacggaaacgtaaccgaaacggtaaacttcgggtacggtacgtacggacctaaccgtattacgttacgttaccttacctacg

SEQ ID NO: 175474 - DNA, 662 bp, Homo sapiens
  misc_feature: GYAE6OF02IY2IS.36.37.D04.1.454.CMB.1.raw
  modified_base (199)..(199): a, c, t, g, unknown or other
  misc_feature (199)..(199): n is a, c, g, or t
  modified_base (478)..(478): a, c, t, g, unknown or other
  misc_feature (478)..(478): n is a, c, g, or t
tcagtacgctgtctcacgaccggtgctcgatttagtagcatactgttgggttgggggagctgctcagttaggacccagagggaaccatggaaaccccagcgcagcttctcttcctcctgctactctggcctcccagataccaccggagaaattgtgttgacgcagtctccaggcaccctgtcttgtctccgagggaagngcccacctctcctgcacgggcagtcagtagtgttagcagcagctactagcctggaccagcaacgaaccgtggccaggcctaccccagtacctcctcatcctagtggtcgcactccagcgacgggccacgtggacactcccagactaggttcagtcggactaggtcggtcgtaggacacggtacttcgactcgtccgaacctactacgacgacacggtacgtaggtaccgtaccgtagggtaagttacgttttgaccgttagtttcgttaacttttacgngttaccaggtactaaagtagttacgtaaccgttaccccgttacccgggttaaccggttccggacccggtaaaccgggacgtaaacgggtacgggtaaactaacccggtaaacggtaaccggttacggttacggtaccgttagaacccgtacctaccgttaccgtacgttccgtacccttacccg

SEQ ID NO: 175475 - DNA, 277 bp, Homo sapiens
  misc_feature: GYAE6OF02GUQ8F.36.37.D04.1.454.CMB.1.raw
  modified_base (247)..(250): a, c, t, g, unknown or other
  misc_feature (247)..(250): n is a, c, g, or t
  modified_base (252)..(277): a, c, t, g, unknown or other
  misc_feature (252)..(277): n is a, c, g, or t
tcagtacgctgtctcacgaccggtgctcgatttagtagcatactgttgggtttgggggtagctaatgactttgactactggggccagggaaccctggtcaccgtctcctcagcctccaccaagggcccatcggtcttccccctggcaccctcctccaagagcacctctgggggcacagcggccctgggctgcctggtcaaggactactccagacagcgtactgagcgggctgggcaaggcgcatagnnnntnnnnnnnnnnnnnnnnnnnnnnnnnn

SEQ ID NO: 175476 - DNA, 599 bp, Homo sapiens
  misc_feature: GYAE6OF02JCF12.36.37.D04.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagtacgctgtctcacgaccggtgctcgatttagtagcatactgttgggttggggagctgctcagttaggaccagagggaaccatggaaacccagcgcagcttctcgttcctcctgctactctcggctccagactaccaccggagaaattgtgttcgagcagtctccagcacctgtctttcgactcgaagggaaangccaccctctcctgcagggccaagtcaagngtcgttagcagcagactacgtagcctggaccagtcaagaacctgcagactccganactcacntacattggctcataccgngacgagggccctaagcggcacttaccganaccgtagttcagcggtnaggttgctggactagtaatcacgtctcaacctntcacgntaccgagcgacgcgtagaacttaagtttcgagtacgttgtattaacgtctacgtacaacgtaagtaacgttcaacgttaacccgtcccggtaacgttaccgaaccggaacgtaaccgtaacgtaggtaaacgttaacgaaacggtaaaacctgggttaacgacgttacgacgtaccgtaaccgtcggttacttacgtactaacccgg

SEQ ID NO: 175477 - DNA, 268 bp, Homo sapiens
  misc_feature: GYAE6OF01E1F7N.23.67.G01.1.454.CMB.1.raw
  modified_base (221)..(223): a, c, t, g, unknown or other
  misc_feature (221)..(223): n is a, c, g, or t
  modified_base (225)..(268): a, c, t, g, unknown or other
  misc_feature (225)..(268): n is a, c, g, or t
tcagacgcgagtatcacgaccggtgctcgatttagagtatacatattgggtttgggcgaagggaccacggtcatcgtctcctcagcctccaccaagggcccatcggtcttccccctggcgccctgctccaggagcacctccgaggagtcacagcggccctgggctgcctggtcaaggctacttccatactcgcgtctgagcgggctggcaaggcgcatagnnngnnnnnnnnnnnnnnnnnnnnnnnnnnnnnnnnnnnnnnnnnnnn

SEQ ID NO: 175478 - DNA, 224 bp, Homo sapiens
  misc_feature: GYAE6OF01BI13U.23.67.G01.1.454.CMB.1.raw
  modified_base (221)..(224): a, c, t, g, unknown or other
  misc_feature (221)..(224): n is a, c, g, or t
tcagacgcgagtatcacgaccggtgctcgatttagagtatacatattgggtttggggcgaagggaccacggtcatcgtctcctcagcctccaccaagggcccatcggtcttccccctggcgccctgctccaggagcacctccgagagcacagcggccctgggctgcctggtcaaggactacttccatactcgcgtctgagcgggctggcaaggcgcatagnnnn

SEQ ID NO: 175479 - DNA, 448 bp, Homo sapiens
  misc_feature: GYAE6OF01BM1Y0.23.67.G01.1.454.CMB.1.raw
  modified_base (354)..(354): a, c, t, g, unknown or other
  misc_feature (354)..(354): n is a, c, g, or t
  modified_base (438)..(448): a, c, t, g, unknown or other
  misc_feature (438)..(448): n is a, c, g, or t
tcagacgcgagtatcacgaccggtgctcgatttagagtatacatattgggtctggagtgggtggcagttgtttcatatgatggaagtaatagaaagtatctcgactccgtggcgggccgattcaccatctccagagacagatctacgaagacggtgtatctccaaatcaacaacctgagaactgaggacacggctgtgtattactgtgcgagagactcggggcggccggtcgtcccccaggacgtacggctactattccgacatggacatctggggcgaagggaccacggtcatcgtctcctcagcctccaccaagggcccatcggtcttccccctggcgccctgctccaggancacctccgagagcacagcggccctgggctgcctggtcaaggctactccatactcgcgtctgagcgggctggcaaggcgcatagnnnnnnnnnnn

SEQ ID NO: 175480 - DNA, 515 bp, Homo sapiens
  misc_feature: GYAE6OF01C2DD7.23.67.G01.1.454.CMB.1.raw
  modified_base (263)..(263): a, c, t, g, unknown or other
  misc_feature (263)..(263): n is a, c, g, or t
  modified_base (504)..(515): a, c, t, g, unknown or other
  misc_feature (504)..(515): n is a, c, g, or t
tcagacgcgagtatcacgaccggtgctcgatttagagtatacatattgggtttggggtgggtggcagttgtttcatatgatggaagtaatagaaagtatctcgactccgtggcgggccgattcaccatctccagagacagatctacgaagacggtgtatctccaaatcaacaacctgagaactgaggacacggctgtgtattactgtgcgagagactcggggcggccggtccgtcccccaggacgtacggctactattccganagtggacatcgtggggcgaagggaccacggtcatcgtctcctcacgcctccaccaacgggccccatccggtccttcccccgtggccgcccctgcctccgaggacgccaccctccgagacgccacgacggccggcccgtggggcctcggcccgtgggtacgaacgggtaccttacgttcccaacttaccgtccggccgttcgtggacgggccggggctcgggacgaaagggccgacagtagnnnnnnnnnnnn

SEQ ID NO: 175481 - DNA, 626 bp, Homo sapiens
  misc_feature: GYAE6OF01BRPGL.23.67.G01.1.454.CMB.1.raw
  modified_base (157)..(157): a, c, t, g, unknown or other
  misc_feature (157)..(157): n is a, c, g, or t
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
  modified_base (569)..(569): a, c, t, g, unknown or other
  misc_feature (569)..(569): n is a, c, g, or t
  modified_base (579)..(579): a, c, t, g, unknown or other
  misc_feature (579)..(579): n is a, c, g, or t
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
  modified_base (620)..(621): a, c, t, g, unknown or other
  misc_feature (620)..(621): n is a, c, g, or t
  modified_base (623)..(623): a, c, t, g, unknown or other
  misc_feature (623)..(623): n is a, c, g, or t
tcagacgcgagtatcacgaccggtgctcgatttagagtatacatattgggtctggagtggggtggcagtttgtttcatatgatggaagtaatagaaagtatctcgactcgtggcggccgattcaccatctcagagacagatctaacgaagacggttntatcctacaaatcaaacaacctgaagtaactggagacgacggtntgtgtattactggtgcgagacgtacgtcgggcggccggtccgtccccgagggaccgtacggctaactacgtaccgatacgtacggactagttccggtggggacggaacgggaaccgaggtacacgttccgtacctccgacgacgtcctaacccaaccggaacggccctaacgtcccggtcccttccccggtcgccnccctggtacaccgtacgggactccgaaccgtaccgganacgacaacgaggcccggtacgtcgggtctcgcgtacggtaactaaccggtacttaccgtacctacgtacgtcgtacgtcgtggacggccgggtcgtacgggacgtaacgggccgtactaaggcgagcagtacgngtagagtacntacgacgacactgnagtcgnactcgatagacacgtacgagnngnacg

SEQ ID NO: 175482 - DNA, 536 bp, Homo sapiens
  misc_feature: GYAE6OF02FKUWE.23.67.G01.1.454.CMB.1.raw
  modified_base (505)..(505): a, c, t, g, unknown or other
  misc_feature (505)..(505): n is a, c, g, or t
  modified_base (508)..(509): a, c, t, g, unknown or other
  misc_feature (508)..(509): n is a, c, g, or t
  modified_base (511)..(516): a, c, t, g, unknown or other
  misc_feature (511)..(516): n is a, c, g, or t
  modified_base (518)..(536): a, c, t, g, unknown or other
  misc_feature (518)..(536): n is a, c, g, or t
tcagacgcgagtatcacgaccggtgctcgatttagagtatacatattgggtctggagtgggtggcagttgtttcatatgatggaagtaatagaaagtatctcgactccgtggcgggccgattcaccatctccagagacagatctacgaagacggtgtatctccaaatcaacaacctgagaactgaggacacggctgtgtattactgtgcgagagacgtcggggcggccggtccgtcccccgaggaccgtacggctactattccgacagtggacatccgtgggggacgaaggggaccacgggtcattccgtcctcctcacgtccctccaaccgaacggggccccagttccggtccctttcccccgtggcccgcccctgcctccgaggcgccaccgtcgagacgcacgacgccggcccgtgggcctcggccgtggaccaaggtacctacttccataccgtcgcgtctggacggcgggtcgtcggacgtaacgggccacgtagtacgntgnntnnnnnncnnnnnnnnnnnnnnnnnnn

SEQ ID NO: 175483 - DNA, 726 bp, Homo sapiens
  misc_feature: GYAE6OF01C9NO2.21.2.A02.1.454.CMB.1.raw
  modified_base (234)..(234): a, c, t, g, unknown or other
  misc_feature (234)..(234): n is a, c, g, or t
tcagtcgtcgctcgcacgaccggtgctcgatttagactcatctactagggaaaggggtgggtccaggaggccacgaacgttcctgggtgtctcacctagtggcctggatccctctacttctcccctcctcactctctgcacgaggtcgtctgaggcctcgttattgagctgtaacgacagccaccctggtgtcagtgtcccaggacgagacggcgaggactcgacctgctcgtncagatggactgaccaaagaatactgcgttaattcggtaaccaacaagaagtccaaggccaaggcccctgtacgttaggtcgatagtaactaaacgacgaacgtgaagacggtccctagagagactccgtaggaagtcgtaattcgactaggccttacgaagtctacgaacgggaaactaggtacgaacggtacgaccgttagaacttaagtaccaagttacgaaacgtacccggaaggaaccgaacggaaacgggaaccgaacgggtactacggaacttagtttaacctagtaacgaaacgtagtaacggacgaagtaacggtaaggttaacgtacgtacggttaggggtaccgtttacgggacgggtaacgggaacccggtaacgggtacgttaacgggaaccccgggttaccggtaaacgggtttaacggaacccgggtaacccggtaaaaggggttcccgttaccggggacccccccggttaaccgggg

SEQ ID NO: 175484 - DNA, 775 bp, Homo sapiens
  misc_feature: GYAE6OF01BEZ2F.21.2.A02.1.454.CMB.1.raw
tcagtcgtcgctcgcacgaccggtgctcgatttagactcatctacagggggaacggggtagggtaccaggaggcagaacgtcgtgggtcgtctcaccatggcctggactcctctacttcgtcccctcctcactctctgcacaggctctgaggcctcctatgagctgacacagccaccctcggtgtcagtgtccccaggacagacggccaggatcacgtggactctgtcgaagatggactgccaaagaagtactagacttaatcggtaaccgaacaggaaccgcgaggccaggcccctgtgttagtgatagtactaaacggcctacgtaggagtaccggtccctacgaggacgtacctcccgtaggaccgtccgtaacttccgtacgggtaccggtccctacccgtaggtaccctacgtacgggaaccgaccgggtacgaacgggtaccgggtaacgttacgggaaccgttaccgtacgtaaggttacggtaacggttacccggaaggggtacgtaaggggtaacggtaacgggtacgggtacgttacgggtaacgttacgtttacgttcgggtaaaccgtaaacggtacggggtaaccgaacggtaacgttaaccgggtacggttaaccggtacgtaacggttccggggtaacgggttacccgggaacccgggtaacgggtacccgtacggtacccgtaccggtaccccggttcccggtaccggtacccgtaccggtaccccgtaacggtcccgtacccgtcccccgttaccggg

SEQ ID NO: 175485 - DNA, 565 bp, Homo sapiens
  misc_feature: GYAE6OF01DXYEH.21.2.A02.1.454.CMB.1.raw
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacgagggaaaggggtgggtccaggaggcagaactactgggtgtctcaccatggcctggatccctctacttctcccctcctcactctctgcacaggctctgaggcctcctatgagctgacacacgcccaaccctgggtcgtcagtcgtcccccagggaccacgacggccaggatcacctgctctgcagatggacctggaccaaagaactgtgacttattggtaaccaacagaagccagccaggcccctgtgtagtgatatataaagacactgagaggcctcagagactccctgagcgattctctggctcagtctcagggacagcagtcagttgactancagtgaatcagacagagacgagctgacttattatgtcaaangtagacagtagaggtactcgtagttcgggtaggttcgggacgggtaagggacccgaaaggtccgttacggacccggttaccggtaaggttacccgaacggtaccccgaaagggtcccgttccggaccccccggtttaccccggg

SEQ ID NO: 175486 - DNA, 846 bp, Homo sapiens
  misc_feature: GYAE6OF01DUXQY.21.2.A02.1.454.CMB.1.raw
tcagtcgtcgctcgcacgaccggtgctcgatttagactcatctacgagggaaaggggggtgggtccaggacggcagaacgtctgggtgtctcgaccatggccgtcggatccctctacttctccccgtcctccactctctgcacgaggcctcgtgaggcctcctatgagctgacacacgccacccttcggtcgttcagttcgttccccaggacaggacggccaggactcacctgctctgcgagatggactcgtaccaaagaatgtgctttagttacggtaaccgaaacggagaacgcccaaggcccacggcccctgtgttagtagatactagtaaagacacgtcgaacgacggtccctacgaggacgtactccccgtaggacggccggtacgtttccgttccgtcggtccttacccgaacgtccgttaccggaacgggggtaacccacgggccgtaccgttacggtaaccgggtttacgtaaccgtttacgttacgtaaacggtttacggttaaacggtttaccccggaagggaaccgaaagggaacgggtaacggaacgggttaccgtacggttaaaccgtttaccgttttaaccgttacggtttaaccgaaaaccgtaacgggtaaaccgtaaccggtaagggttaaacgggtaaacgttaaccgttaaccgtaagggttttcgggggttacggttaccggggaccggggtaaaccggggtaacccgtaacgggttacccggttaaccggttaccccggttacccgttaaacggggttaccccgttaacccggacccccgttaaacggggtccctttccccgggttaccccggtttaaccccggg

SEQ ID NO: 175487 - DNA, 515 bp, Homo sapiens
  misc_feature: GYAE6OF01AY60Y.21.2.A02.1.454.CMB.1.raw
  modified_base (315)..(315): a, c, t, g, unknown or other
  misc_feature (315)..(315): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagagaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgccaaaagaaatatgcttattggtaaccaacagaagccaggccaggcccctgtgttagtgatatataaagacactgagaggccctnaagagatccctagagcgattctctggctccagctcgagggacagcagtcacgttgactatcgagtgaagtccaggcaggaggacgaggctagactaattactgtacaaanagtagacagtagagtactnagttggtgttcggacggtaggaccgaagctagacccgtcgtaggtacacgacccaaggcctcggtcccccg

SEQ ID NO: 175488 - DNA, 793 bp, Homo sapiens
  misc_feature: GYAE6OF01EARIG.21.2.A02.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagactcatctacagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagattcattgaccaaaagatatacttgttggttccagcagaagtcaggccaggcccctgtactggtcatccatgaggcagtcgacgacactccgggatccctagagagattcnctgccctccgagcctacgagggactacggtcggcctaacctttggaacttacgtcgaagggttcgggggaccccgtaggggttacgggaaccgtaagtacggaaacgtcgttacgggtaacctttaacgttaacgttttacggtttaacccgtacccgtaaacccgtaacgggtaaccgtaaacgggtttaacgggttacgggttaccgtaaacggtttaccggggtaaacggggggggtttaacgttttcccgggggggaaccgggggtaaacggggggtaaaccccggtaaaacggggtttttacccgggtaaaccccgggttttccccggttttaacgggggttaccccggaaccgggtaaccccccggtaaaacgggggttcccgttaccccgggttacccccccccggtttaccggggtttacccctaacccgtttccccggttttaacccccccggg

SEQ ID NO: 175489 - DNA, 659 bp, Homo sapiens
  misc_feature: GYAE6OF01A8W3D.21.2.A02.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagactcatctacagggtaaaggggggtgggtccaggaggcagaactctgggtgtctcaccatggcctggatccctctacttctccccctcctcacctctctgcacaggctcgtgaggccctcctatgacgctgacacagccacccctcggtgtcaggtcgtccccaggacagaccggccaggactccacctgctctgcagatggactgaccaaagaaatatgcttattcggtaaccaaacagaacgcccgaggaccaccggacccctgtagttagtgtaattagtaataaaagactacgtaggacgaccggccctagagacgacttcccgngacgcgtacttcgtacgtggcctccgagtcctacggacggtaccagcctagtcctacgttgactagtcgagtagacgtcgaggacaggaaggtacgaggtactacgtaacttacttactagtaacctaaacgtaagttaacgaacgtaaggttaagggaacgttacgtacgtacggttagggttacggttaccgggaccgggtaaccgggtaaccgaggtaccgtacgggtacccggtaccgtacggtacccgtaaccggacccgaacggtccctcccggtcccccccgtaccgg

SEQ ID NO: 175490 - DNA, 586 bp, Homo sapiens
  misc_feature: GYAE6OF01ELJOO.21.2.A02.1.454.CMB.1.raw
  modified_base (240)..(240): a, c, t, g, unknown or other
  misc_feature (240)..(240): n is a, c, g, or t
  modified_base (375)..(375): a, c, t, g, unknown or other
  misc_feature (375)..(375): n is a, c, g, or t
tcagtcgtcgctcgcacgaccggtgctcgatttagactcatctacagggtaaagggggttgggtccaggaggcagaactctgggtgtctcaccatggcctggatcctctacttctcccctcctcactctctgcacaggctctgaggcctctatgagctgacacagccaccctcggtgtcagtcgtcccaggacagacggcaggatcacctgctctgcagatggactgaccaaagaaattntagctttattaggtaaccaacaagaacgccgacggccacggtcccctgtgttagtgattataataaagacacgtgacgacgcctacgagagactcccgtagacgcgtattctcgtgctccgagtctcgacggacngctagtcgtagttacgacttactcgagtacgaacgttcaggcaggaggacgaggtctagacttaatacttagaactaacgagtaacgaacgtaggtaagtacgttactacgtaggttgggtcggttacgggcggtaacgggaccgtaacgtgtacggtaccgttaccgtaggtaccgacggtacccgaaggtccgtccgccccgttaccgg

SEQ ID NO: 175491 - DNA, 984 bp, Homo sapiens
  misc_feature: GYAE6OF01AXJGU.21.2.A02.1.454.CMB.1.raw
tcagtcgtcgctcgcacgaccggtgctcgatttagactcatctacaggggaaacgggggtgggtacccaggaggccacgaactctagggtccgtctcacccataggccctaggatcccgtctacgttcctcccccgtccgtcaccttcttctggcacaggctcctgaggcctcctatcgaggcctgtacacgagccacccgtcgggtgtcaggtcgtccccaggacgacggaccgccaggatccgaccttcgctctaggcctagtagtacggtactcggaccctaaaaggaaattagttagtacgtttattacgggtaaaccaacgtaggaacgtcccgacgggacccgacccgggtacccctagggttcgttacggtaggtagtacgttaagtaaaacggccgtaacgttcgggacggtaccgggtaccccttacgaacggtaacggtaccgttaccccgtaggtaacgtaccgtaacgtttaccgttaccgtttcgggtacccttacccgaacgggttacccgttaccggtaaacgggggttaaccacggtaccgtaacggttacccgtaaccggtttacgtaaccccgtaagtacccggtaaggttaccggtaaacccggttaccggaaacggggtaccggtaacggggtaacggggtaacccgggtaacgggttaccgttaacggtaaccgtttaacgtttaaccggtaacggtaacccgtaaaacggttggttaaccggtaaccgtaaaggtttaccgggtaacggttaaccgttaccggttaagggtttacggggttacgggtttacccggggtaacccggggtaacggggtaaacccccgggtaagggttaccccggggtttaaccccggtaaaccccggtttttccccggaaacggggttttcccgaaaccccgggggtacccccgaaaacccggggttcccccgttaccccgggtccccccggtttaaccccggg

SEQ ID NO: 175492 - DNA, 649 bp, Homo sapiens
  misc_feature: GYAE6OF01AB3ZT.21.2.A02.1.454.CMB.1.raw
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
tcagtcgtcgctcgcacgaccggtgctcgatttagactcatctacgagggaaggggtggtccaggaggcagaactcgtgggtgtctcaccatcggcctggactccctctacttcctcccctctcactctctgcacaggtctactggacgtcctctatggacgtctgacacacgtcccaccgttggtctcacgttcgacccaggaccaggaccggctaggctcaccgtgccttngacagtatggactgacaaagatgcgtatagtacgacaanacgacgcgtaggccacggtcctgtagttagacgtataacgtaanaacgaccgtagnggaacgcgtacccngacgacgtctccgtgacgcgtctttcgcgacgctacngtcgacgaggaccagtcgtacgtactacgttagactacgtagtagtacgacgacggagagaacgaggttacgcggaacttacggacttaacgtacgtaacgaactaacgtcggttaacaacggtagtttaacgggaccgttactaagggtttcggtagggtttacccgggtgggaaaccggtttagggaaaccctcgggttaccgtacggcccgtttacccggagttacccgaccggtaccggttaaccgcccgtacccgttcccggtcc

SEQ ID NO: 175493 - DNA, 743 bp, Homo sapiens
  misc_feature: GYAE6OF01C7I6F.21.2.A02.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagactcatctacgaaggggaaagggggtgggtccaggaggcagaacctcctgggtgtctcaccatggcctggatccctctacttctccccctcctcactttctgcactgtctctgaggcctcctatgagctgacacagccaccctcggtgtcagtcgtccccaggacaaacggccaggatcacctgctctgganattcattgaccaaaagatatacttgttgtccagcagaagtcaggccacggccctagtactggtcatccatgagccagtcgacgacacgtcgggactcccgtgagagtattctctcgcctcagctcgaggacaggtcgaccctacgtttagaacttagtacgacgggttcgggggaccccgtaagggggttcggaacgggtagtacgggaaacggtcgtaaggtaaccttaacgtttagtttcggttaaccggaccaacccgtaaggtaaccgtaggttacggttcggtacgtaaggttaccgggtaaggggggggtttacgttaccggggggacggggtaacggggtacccgttaaaggggtttcccggtaacccgggtttcccggttacggggtacccgtaaccgggtacccccggtaacggggtccccgttccccgggtaccccccgttccggggttacccttaacccggtttcccgtttccccgggttcccccccgtcccccttttcccccgg

SEQ ID NO: 175494 - DNA, 703 bp, Homo sapiens
  misc_feature: GYAE6OF01C5YR6.21.2.A02.1.454.CMB.1.raw
tcagtcgtcgctcgcacgaccggtgctcgatttagactcatctacagggtaaagggggtggtccaggaggcagaactctgggtgtctcaccatggcctggatccctctacttctcccctcctcactctctgctacaggctctgacgccgtcctatgagcctgacacagcccacctcggtgtcagtcgtcccaggacagacggcagactccacctgctctgcagactggacctggaccaaaagtaatgtgtactttattacggtaaccaacgtaagaacgcccaaggccaacggcccctaggtacgttaagtacgaattaactaacttaaacgactacgtagacgaccggtaccctacgacgtacgtacgttacccgtgacgtcctactttccgtcgtcggccttaccgacgtccgtacgaacgggtaccacggtacctacgtacgtaaccgtttacgaaccgttagtaccggtaacgtcgtaaacggttcccgaacgggaacgtaacgggaccggaacggtacggtacttaacgtaacttaacgttactaaccgaactaaacgtaagtaacgtacgtaagtaacggttacgttacttacgttacggttacgggtgttacgggacggtaacggaccgaaggtccgacggtacccgtacgtacggtaccgacgacccgaaggtccctacccgtccccgtaaccgg

SEQ ID NO: 175495 - DNA, 276 bp, Homo sapiens
  misc_feature: GYAE6OF01CB5PV.21.2.A02.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (246)..(276): a, c, t, g, unknown or other
  misc_feature (246)..(276): n is a, c, g, or t
tcagtcgtcgctcgcacgaccggtgctcgatttagactcatctacgaggggaaagggactggagtggttattattcctggggccagggtaaccctggtaaccgtctcctcagcctccaccaagggcccatcggtcttccccctggcgccctgctccaggacgcacctccgagagcaacagcggccctgggctgcctggtcaaggctactccctgtctctacngagcgggctggcaaggcgnatagnnnnnnnnnnnnnnnnnnnnnnnnnnnnnnn

SEQ ID NO: 175496 - DNA, 822 bp, Homo sapiens
  misc_feature: GYAE6OF01DU98B.21.2.A02.1.454.CMB.1.raw
  modified_base (261)..(261): a, c, t, g, unknown or other
  misc_feature (261)..(261): n is a, c, g, or t
tcagtcgtcgctcgcacgaccggtgctcgatttagactcatctacaggggtaaagggggtgggtccaggaggcagaactctgggtgtctcaccatggcctggactccctctacttctcccctcctcgactctctgcacaggctctgaggcctcctagtgagctgacacagccacctcggtgtcagtcgtaccccagggaccacggaccggccgaggactccgacctgcctctgcgagagtcggactcgaccaaaagaactntagtactttaagttacggtaacccaaacgtaacgaacgtaccgtaacggtaccgtacgggtacccccgttaggttacggtttaaggtacggtaacgtttaagtaaacgttaaaacggtaaccgtaaccgtacggaacggtaccggtcccgttacgaaggtaacggttaccggttacccgttaggacggtaccggttacgtttccgtccggtcggtccgtaccgacggtcgtacggtaacggggacgtacggtacgtacggtacctacggttacgtaacgttacgttaacgtacggttaacgtaaacggttaccggaaggtacggaagggtaacgggacggtacggtacgtacggttacgtttaaggtttaaccttaggtaaccgtaacgtacgtaacgtaacgtaaggttaacggtaaccgttaacgttacggttagggtttacgggtcggttaccgggggacggtaacgggtaaccggtagtacggtacggacccgttaccggtaacggtaccgaaccgggttacccgaacgggttccccgtccggtcccccgttacggg

SEQ ID NO: 175497 - DNA, 843 bp, Homo sapiens
  misc_feature: GYAE6OF01BIEZ7.21.2.A02.1.454.CMB.1.raw
  modified_base (252)..(252): a, c, t, g, unknown or other
  misc_feature (252)..(252): n is a, c, g, or t
tcagtcgtcgctcgcacgaccggtgctcgattttagactcatctacaggggtaaaggggggtgggtccaggaggcagaactctgggtgtctcaccatggcctggatccctctacttctcccctcctcactctctgcacaggctcgtgaggcctctatgagtctgacacagaccaccgtcggtgtcagtcgtcccaggacagacggccaggactaccacctgctctgcagatggactcgaccgaaagtaaatntcgtctttacgttacggtaacccaacgtaggaacggcccgtaacgggtcccaacgggtccccttaggttacgtttaccggtgtaacttaagttaaactaaaacggaccgtaacggtacggaacggtaaccggtaccccttacgtaacggtaacgttaccgttccccgtaggaccggtaccgtaacgtttcccgtcggtacgggtcccttaccgacggtaccgttaccggaacgggggtaacctaagggtacccgttaaacggtttacccgttaaccgggttttacgtaaccgtttacgttaccggtaaggggttacggtaaaccgttacccggaaagggtaaccggtaaacgggtaaacgggaccgggtaacggtccgttaagggtaacctttaagttacgtacgtaaacgtaaacgtagtaacgaacgtaaggtaacggtacgttaacgtacggttaggttcggggttacgtaccgggggtacggtaaacgggtaaccgttacgggtaccgttaccggtaccggttaccgttaggtaacccgaaccggtacccggaaggttccccgttccccgggtaccccgttaccggg

SEQ ID NO: 175498 - DNA, 642 bp, Homo sapiens
  misc_feature: GYAE6OF01C5CQW.21.2.A02.1.454.CMB.1.raw
  modified_base (147)..(147): a, c, t, g, unknown or other
  misc_feature (147)..(147): n is a, c, g, or t
  modified_base (159)..(159): a, c, t, g, unknown or other
  misc_feature (159)..(159): n is a, c, g, or t
  modified_base (272)..(272): a, c, t, g, unknown or other
  misc_feature (272)..(272): n is a, c, g, or t
  modified_base (516)..(516): a, c, t, g, unknown or other
  misc_feature (516)..(516): n is a, c, g, or t
  modified_base (630)..(630): a, c, t, g, unknown or other
  misc_feature (630)..(630): n is a, c, g, or t
tcagtcgtcgctcgcacgaccggtgctcgatttagactcatctacgaggggaaagggggtgggtccaggaggcagaactcgtgggtgtctcaccatggcctggactccctctacttcctccccctcctcactctctgcacaggctcngacggcctctangagctgacacacgccacccgtggtcgtcacgtccgacccgaggacacggaccggactaggactccaccgtgacctctgacgaagagtacggactacgaaaccaaaagtaaatnttacggtactttacgtaacggtaaccaaagacgaacgccgtaacggaccgacggtcccgtgtagttaggtataataataaacgaaagacaagtaggaacgaccgtaccacgaacgacgtactaccgaggacgtacgtactttcgtacgtcggacctacggacgtacgacggacggacgacgatacggtactacggttagactagtacgaggtacgaacgtcggaggacgagggaacgacgacgngtaacgtactagtacgataacaagtagatagagtaagactatggtagttggtcggacggacggacgtacgacggtcacggttaccgcgacggtacaaccggacgaacgggtccncccggtccgtcg

SEQ ID NO: 175499 - DNA, 712 bp, Homo sapiens
  misc_feature: GYAE6OF01AG9O1.21.2.A02.1.454.CMB.1.raw
tcagtcgtcgctcgcacgaccggtgctcgatttagactcatctacgagggaaagggggtgggtccaggaggcagaactctgggtgtctcaccatggcctggatccctctacttctccccctcctcactctctgcacaggctctgaggccctcctatgagctgacacacgcccacccgtggtcgtccaggtcgtccccgaggaccaggaccggccgagggatccgacctgctctgccagactggacctagaccaaaagtaaatgtgtaccttagttacggaacctaacgacgaacgccgaggtaccacggtcccctaggttcggttagtgtaattaataactaaacgacctacgtgacggaccggacccagaacgacgtacctacccgtgacgcgtactttcgtccgtcggcctaccgtacgtccgtacggacggtaacacggaccgtagtaccgtacggttacgtaccgttacgtacgtacggttaaggaaccgttacccgggagtaaccggaagggtaacggacgggtacggtacgtacgtaacttacgttacgttacgaaccgtaaacgtacggtaagtaaccgtagggtaacgtacggttacgttacgtaggtttacgggtcggtacggggaccggtaggacgtacggtcgtacggcccgttacggtcgtaccggaccgaccgtaggcccgtcccggtccccgtaccgg

SEQ ID NO: 175500 - DNA, 848 bp, Homo sapiens
  misc_feature: GYAE6OF01DOBO8.21.2.A02.1.454.CMB.1.raw
  modified_base (142)..(142): a, c, t, g, unknown or other
  misc_feature (142)..(142): n is a, c, g, or t
  modified_base (153)..(153): a, c, t, g, unknown or other
  misc_feature (153)..(153): n is a, c, g, or t
  modified_base (834)..(834): a, c, t, g, unknown or other
  misc_feature (834)..(834): n is a, c, g, or t
tcagtcgtcgctcgcacgaccggtgctcgatttagactcatctacgagggaaagggggtgggtccaggaggcagaactctgggtgtctcaccatggcctggactccctctacttcctcccctctcactctctgcagagctcngacgcctctangagctgacactacgccctacccgtggtgtacacggttcgaccccgaggtaaccgaggaccgggtaccaagggtaccttcccgaccgttggccttacgtacggaccgaaggtacgttacgggaactacggaaaccaaaaagtaaatttcgttagtaacgtttaacggttaccggaaaccaaacgtaacggtaaaccggacccgtaaccgggacccgtaaccgggtcccccgtttagggtaaccggtttaacgttaacggttaaacgtttaaagttaaaacggttaaaacgaacccgtaaccggttaaagggaaaccggttaccggaccccttaaggaaacgtaccgggtacctaccggtagtaacgtaccgtttaacgttccggttaaccgtcggtaccttaccgacggaccgtagaacggggtaacagtaccgtaaacgttacgttaacggtaacgtacgttacgtacgtaacgttaacggacggtaaccggacgtaacgggaacgggtaacgggtacggtacgtcgttaaagttaacccttaagttaaccggttagaaacgtaaagtcggaacttaacggaaggttaacgtaacgttatacgggtaggtcgggtacgtagggaacggaaccggtaagcgtacgtacgtccggtacgcgtaacgaccggacgacggtcccnccggtccctaccgg

SEQ ID NO: 175501 - DNA, 786 bp, Homo sapiens
  misc_feature: GYAE6OF01C5VMG.21.2.A02.1.454.CMB.1.raw
  modified_base (140)..(140): a, c, t, g, unknown or other
  misc_feature (140)..(140): n is a, c, g, or t
  modified_base (183)..(183): a, c, t, g, unknown or other
  misc_feature (183)..(183): n is a, c, g, or t
  modified_base (754)..(754): a, c, t, g, unknown or other
  misc_feature (754)..(754): n is a, c, g, or t
tcagtcgtcgctcgcacgaccggtgctcgatttagactcatctacgaggggaaagggggtgggtccaggaggcagaactctgggtgtctcaccatggcctgggatccctctacttcctccccctcctcactctctgcacnggctctggagtcctctatgagctgacacacgcccacctgggtntcaggtctacccgaggacaggaccggtcgaggactccaccgtgcctcgtggcagatcggacctaggaccaaaagtaattgtgtacttacgttacggtaaccaacgtaacgaacggaccgacgggaccgaacggtcccccttaggttaggttagttaggtaacttaataacgttaaacggactacggttaacggacggtaccgggtacctacgaacgttacgaccgtaccgtggaacgtccggtatttccgtcggtcgtcccgtacgtaacgtcggtaccggtaaaggggtccaacggtacgtacggtaccgtttacgtacgtaccgttaacgtacggtaagtccggtaacggttccggaaacgggtacggaacggggtaaccggacggggtaacgtcggttaaacggtactttaacggtaactttaacggaagttaacggaagttaaccggtaagttaagtaacggtacgtttaccgtaggttaagggttccggggttaggccggggtaaccggaaggacccgtagttaccggaccggttaccggtccgtaaggtaccgaccgggtaaccnccgggttcccgtaacccgtcccggttaaccgg

SEQ ID NO: 175502 - DNA, 779 bp, Homo sapiens
  misc_feature: GYAE6OF01D0E9F.21.2.A02.1.454.CMB.1.raw
  modified_base (181)..(181): a, c, t, g, unknown or other
  misc_feature (181)..(181): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
tcagtcgtcgctcgcacgaccggtgctcgatttagactcatctacgagggaaaggggtgggtccaggaggcagaactctgggtgtctcaccatggcctggatccctctacttctccccctcctcactctctgcacaggctctgaggccctcctatgagctagacacagcccacccgtggtntcagtcgtccccaggacagaccggccaggatccacctgcttcngcagntggactgaaccaaaagaaattntgtactttagttacggtaacccaagaacggaacgcccgaggccgaacggtcccccgttgttacgttagttgaattataattaaaacggacacgttagaaggaccggccctagaagtacgacttcccgtagacgtacgtacttactcgtcggtcctaccgaagtccgtacggaacgggtaccacggtaccgtaacgttaccgtaacggtttcgtaaccttacgtaccgtaacggtacgtaaaccggttaccgaacgggaccgtaaggaaccgggacggtacggtaccgttaagtaaccgtttaacgtttaacgttaacccgtaaccgtaaaacgtaaggtaacggtaacgtaagggttaaccggtaaggttacccgttagttaacgggtttgggttacgggtaccggggtaaccgggaacggggtaaccgtaaccgggtacggttacccggtaacccgttacccgggtaaggtacccgtaccggtaacccggaccgggtcccgttcccccggtcccccgttaacccggg

SEQ ID NO: 175503 - DNA, 728 bp, Homo sapiens
  misc_feature: GYAE6OF01DXXHG.21.2.A02.1.454.CMB.1.raw
  modified_base (255)..(255): a, c, t, g, unknown or other
  misc_feature (255)..(255): n is a, c, g, or t
  modified_base (394)..(394): a, c, t, g, unknown or other
  misc_feature (394)..(394): n is a, c, g, or t
tcagtcgtcgctcgcacgaccggtgctcgatttagactcatctacgagggaaagggggtgggtccaggaggcagaactctgggtgtctcaccatggcctggatccctctacttcctccccctcctcactctctgcacaggctctgaggcctcctatgagctgacacacgccctaccctcggtgtcagtccgtcccaggacagacggccaggactcacctgctctgacagagtggactcggaaccaaaagtaaatntagtactttaagtttacggtaaacccaaacgaaggaaaccgacccgaacgggacccgaaccggtccccgttaggttacggtttaaggtagtaattaaacgtaaagtaaaacgtacacgtaggacggaacggccccttanaagacgtactcccgtagacgtacgtacttcgtcgtcggcctccgacgtccgtacggacgggaacacggtaccgtaacgttcgtaaccggtttagaacctttagtacgtaacggtagaaaccggttccgaaggacgaagggacgggaacgtacggtcgtacgtaactttattaccgagtaaaccgaaagtacgtaagaacgtaaggtaaccggttagtaccgttacgttaggttcggggtcgtacggggacggaacgtaccggaacgtcggttacggtacccgttacggtacggacccgaaccggacccgtaaggtcccctcccgcccgttccgg

SEQ ID NO: 175504 - DNA, 1095 bp, Homo sapiens
  misc_feature: GYAE6OF01DJ3J1.21.2.A02.1.454.CMB.1.raw
  modified_base (85)..(85): a, c, t, g, unknown or other
  misc_feature (85)..(85): n is a, c, g, or t
  modified_base (284)..(284): a, c, t, g, unknown or other
  misc_feature (284)..(284): n is a, c, g, or t
tcagtcgtcgctcgcacgaccggtgctcgatttagactcatctacgagggaaagggggtgggtccaggaggcagaactctgggtnctcacatggcctggactcctctacttcctccccctcctcactctctgaccacgaggtccttcgtacggacggtcccttacgttataggacgtccgtacgaaccaccgaaccgccccgtacccggttggtcggttacctacgggtccccgtacccggaaaggaccgaacggaccgggtaccgaaggtacctaccctcgtntccgtacggtagacaggttacgaccggtactaaccgaaaagttaaagttacgtacgtttactaaaccgttttaagttaaacggaaacccaaggtaaccggacgaccgtacggcccgtacggttaccgtttagtacggttaagtaacgaacgtaaaacgtttaaacgaacggtacgtaaaggtcgggtaaaacccggtcccgttacgaaaccggtacgtaaaccggttcccgtaccgggtaaacgtcccgggtttaccgtttaacctttacgggtcccggttaaccctcccggtttaaacggtacccgggaacccgggtaaacggggaacttaacccggacggtttaaccggttaaccccgttaaggttttaacccgggtaagttttaccggttaaaccggttaccgggtttaaacggttaccgggtaaacccggggttaagtaaccgggggaacggtaaccggggtaaacggtacccgggttaacgggtttaaaccctttaaaccggtttaacggtttaaaccggttaaccgggtaaacccgttaaacgggtaaaccggttaaacgggtaaaccgtttaacgggtaaacgggttaaacggtttaaccggttaaccgggtttacggggtttaccggggttacgggggttaaccggtaaccgggggttaaacccgggaaaaccggttccggggtaacgttaacccccgggtttaaccgtacccggggttaaccgtacggaaccccccggttaaacggttccccgggtaacccgtttaccccgggtcccccggggtttacccttaacccccggg

SEQ ID NO: 175505 - DNA, 723 bp, Homo sapiens
  misc_feature: GYAE6OF01BM69J.21.2.A02.1.454.CMB.1.raw
  modified_base (264)..(264): a, c, t, g, unknown or other
  misc_feature (264)..(264): n is a, c, g, or t
  modified_base (332)..(332): a, c, t, g, unknown or other
  misc_feature (332)..(332): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacgagggaaagggggtgggtccaggaggcagaactcgtgggtgtctcaccatggcctggactccctctacttcctccccctcctcactctctgcacgaggctctgacggcctcctatgagctagacacacgccctaccgtggtgtctacgtcgtcccgaggacgaggaccgacgaggactccacgtgctcgtgacgagagtcggactcgaactaaagtatntcgtacttagtacgtaacaacgagacgtaccgacgtccgacggtcctgttagttacgtataagttaanaacgtaacgacgtagtaggacgaccggtccagaacgaccgtacgtaccgaggtaccgacgttcttacgtcggtacgggtacctcgtcggtaccgtaggaacgggacncgtacctaaggtcttaacggttacacgtactacgacgggttacaacggtacggacgtaacgtaagggacggtacgtacggtactaacgttacgttaacgtactagtaaaccgaagtagtaacggaacgtacgggtaaggtaccgttacgtttagggtacggggtttcgggtaacgggccgggtaaagggtaaccccggtacgtaggttacccgggtaccgtaaacccgttcggaaggccccgtaagggttacccccagggttccccgccccgttcccggtacgg

SEQ ID NO: 175506 - DNA, 745 bp, Homo sapiens
  misc_feature: GYAE6OF01DRKFL.21.2.A02.1.454.CMB.1.raw
  modified_base (135)..(135): a, c, t, g, unknown or other
  misc_feature (135)..(135): n is a, c, g, or t
  modified_base (172)..(172): a, c, t, g, unknown or other
  misc_feature (172)..(172): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (453)..(453): a, c, t, g, unknown or other
  misc_feature (453)..(453): n is a, c, g, or t
  modified_base (520)..(520): a, c, t, g, unknown or other
  misc_feature (520)..(520): n is a, c, g, or t
  modified_base (531)..(531): a, c, t, g, unknown or other
  misc_feature (531)..(531): n is a, c, g, or t
  modified_base (573)..(573): a, c, t, g, unknown or other
  misc_feature (573)..(573): n is a, c, g, or t
tcagtcgtcgctcgcacgaccggtgctcgatttagactcatctacgaggggaaagggggtgggtccagggaggcagaactcgtgggtgtctcaccatggcctggactccctctacttcctcccctctcactctcngacacgaggctctggacggcctctatgagcagacacncgaccaccgtggtgtcacggttccgcccgaaggacgtaggaccggaccgtaaggactcacctgctcgngacgagtagnggacacgaacgaaagaatcgtgtaactttaggtaacgaacaacgaagaacgaccgacgggttccaacggtcccttaggttaagtacggtaagtaattaaggtaactaaacgacctaaggtagaaccgggccaccgttagaaacggttacgaccttaccgaagggactacggtactttacgccgttacgggtacccaaggtacncggtaacggacggttacgacggatacgaccgttaggtaccaacgacgttagaacggtaagacggtanaaacgggttanaagggacggaacggaacgtcgtttaacaactttaccgttaanaaccgggaactaaaacggtaccggtataaccgggtaaaggttaacgacggttaccttaggaagggtttcggggagtacccggggtagaaacccgggttagacgtaccgttacggacccgtgggtaaaccgccgttaacgacccgtaagggtccaacccggtcccgttaacgg

SEQ ID NO: 175507 - DNA, 764 bp, Homo sapiens
  misc_feature: GYAE6OF01C3ERB.21.2.A02.1.454.CMB.1.raw
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagtcgtcgctcgcacgaccggtgctcgatttagactcatctacagggtaaaggggggtgggtccaggaggcagaactctgggtgtctcacatggcctggatccctctacttctccccctcctcactctctgcacaggctctgagtcctctatgagctgacacacgcccacccgtggtctcagtcgtcccgaggacaggacggccaggactccacctgcctctgcagtagtcggactagaaccaaagaaattntcgtatttagttacggaaccaanacgaacgccgacggcccgacggtcccttagttacggttagtagtaattaagtaaagtaacgtacacgtaggacggtaccgtaccctacgaacgacgtaccgtaccgtacgacgtccgttattccgtacggtcgtaccctacgaacgtccgtaacggtacgggactacgacgtacgttacgtacgttacgaacttcgtacggtaggtaacgtacgtacggagtacggaacggtacgggtacgacggtacgtacgttaaacgttactttaacggaccgttaaacgtaaacggttacgtaacggtaagggttaacggtaacgttaacgggttaacgttaaggttacggggtttaccggggttacgggtaccggggaaccggggtacggtaaacccgtacggtacccggtaccggtaacccgggttcgtaaccgggacccgtaaccggtaaccccggtaccgttacccggtcccccgttaccccggtacgg

SEQ ID NO: 175508 - DNA, 718 bp, Homo sapiens
  misc_feature: GYAE6OF01C54AZ.21.2.A02.1.454.CMB.1.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
tcagtcgtcgctcgcacgaccggtgctcgatttagactcatctacgagggaaagggggtgggtccaggaggcagaactctgggtgtctcaccatggcctggatccctctacttctccccctcctcactctctgcacaggcctcgtgagcctcctatgagctgacacacgcccacccgtcggtgtctagtcgtccccaggacaggacggcaggactccactgctctgcagntggactgaacaaagaatntgtactttagtcggaacctaacgagaacgccgacggccgtacgtcccgtagtacgttagtgtaataataagtaacactacgtacgacgtacggccctagaggactacgtcccgtagacgtaccgttatttccgtaccgtaggtcccctacggacgttcccggaacggaacggaccgacgtacgtaacgttaccgtaggtttacgtaaccgttacgtacgtaacggttagaaccgttaccggaagaccgaaggacgggtacgtaggtccgtacgtaacgttatttacgactaacgaacgtaagtacgtaacggtagttacgggagttacgtaacgttcgggttaggggtttacggttaccgggacgggtaaacggtaacccggtaaggtcccgttaccggtaacccggttaccggtaacggtaccggtacccgtaacccggtaccgtcccgtccccggtacccgtacccgg

SEQ ID NO: 175509 - DNA, 770 bp, Homo sapiens
  misc_feature: GYAE6OF01DQPLN.21.2.A02.1.454.CMB.1.raw
tcagtcgtcgctcgcacgaccggtgctcgatttagactcatctacgagggaaagggggtgggtccaggaggcagaactctgggtgtctcaccatggcctggactcctctacttcctccctctcactctctcgcacgacggtctctacggacggtcctacttagtcgacgctacgacacacgccctaccgtcgggtactcgtacgtccgtacccgaggacgacggaccggaccgaaggactaccgtaccgtcgccttctcgacgaggtacgtacggaccgtaagaaccgaaaaagtaacttagtacgtaacgtttacgtaacgtaaaccgaacggtaacgaacggaccgtacggaccgtaccggtccttaggttaacggttaggtaacgtaagtaaataacggtaaaacgcgtaacgtggtaacggcgtacccgtagacgtacgtacgttacgacgtacgtacgttacgttcgtacgtcggtactacgacgtacggtaagaacggtacaacgcgttaacgtcgtaacggtacgaacttacgtaggtacgtaacgaccggtacggaagacggtaacggacggtacgacgttaacgtacgttaacttaacggtataacggtaacgaaacgtacggtaagacgttagaaacggttagttaacgggtacgttacgggttagggttacgggtcgggaacggtaacggacgtacggtagaccggttacggtacgtataccgggaccacggtcctacccgggtccgtacccggttacg

SEQ ID NO: 175510 - DNA, 793 bp, Homo sapiens
  misc_feature: GYAE6OF01DIPPH.21.2.A02.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
  modified_base (555)..(555): a, c, t, g, unknown or other
  misc_feature (555)..(555): n is a, c, g, or t
  modified_base (602)..(602): a, c, t, g, unknown or other
  misc_feature (602)..(602): n is a, c, g, or t
tcagtcgtcgctcgcacgaccggtgctcgatttagactcatctacgaggggaaagggggtgggtccaggaggcagaactctgggtgtctcaccatggcctggactccctctacttcctcccctctcactctctgcacaggtctcgtgacggcctctatgactcagaccacgacgccctacccgttggtctcaggtccncccgagacgacgacggccaggactaccaccgtgtcctntcggacagactcggactacggaaacctaaaagtaaattgtaggtaactttaacgtacggttaaaccaagtaaacggacgaccggaacggcctaacggtcccttaggttagttaactaggaacttaagtaaacgtaacacgacgtaggaacggtccgacctaggagacgtaccctacgnggtaacggacttcttcgacggtacgtccgtacgaacnccgggtaacggaaggtaaccacggttaagtacgtacgttaacggtactaacggttacaggttaaccgtaagtaacggtacgaacgacgaaaggacggtaacggnggtaacctaggtattaaccttataacgtaacgaaacgttagggaaanacggttaaaggtactaaccgggttattaccggtttaaggggtcgggtttaaccggacgggggtaaacggaaccgggttaaccgtaaaccgtaggttaccccggggttaaacccggttaacgttaacccgggacgtaacccgggtaaacccggtaacccggtttcctaacccccgggttcccgtttaaccgg

SEQ ID NO: 175511 - DNA, 800 bp, Homo sapiens
  misc_feature: GYAE6OF01CXACR.21.2.A02.1.454.CMB.1.raw
tcagtcgtcgctcgcacgaccggtgctcgatttagactcatctacgaggggaaagggggtgggtccagggaggcagaactcgtgggtgtctcaccagtggcctggactccctctacttcctcccctctcactcctctacgcacgaggcctcgtagacggtcctacctatgacgctacgacacacgcccaccgtcggtgtccagtacccgtcccgaaggacacggaccgccgaggactccaccgttgacctcgtagacgtaagtacgtcggacctacggtaaacccaaaaggtaaactttagtacgttaacgttttacggttaacgggtaaccctaaggaaacggtaaccggaccggaaccggtcccgaaccggggttaccccttagggtttaagtaacggtataaaactttaaggttaaaaccggtaaacacggttacacgggtaaacggacccgggttacccaaggaaccgtaaccgacgtttaccaacgggaacgtccgttaccttcggtaccgtacgggtacccttacccgaggttaacccgggaggaaccggtacgtacggaccgtaacgggttacccgtaagttacccgtacgtaacgtacggtaacgacgtaacggaccgtacggacgaacggtacggtaacgacggtacgacgtactaacgtatacgtaacgtaacagtacgacgtaacgtagtacgtacgtacgtagtcgggtaggttacgggaggtacgacggactaccgacggtaccgtacgtaagaccggtaccacggaccgtcgccgtcccggtaccg

SEQ ID NO: 175512 - DNA, 875 bp, Homo sapiens
  misc_feature: GYAE6OF01B85VZ.21.2.A02.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagactcatctacgagggaaagggggtgggtccaggaggcagaactcgtgggtgtctcaccatcggcctggactcctctacttcctcccctcctcactctctgcacagctcgtgacgccttctatganctgacacacgcccgtaccgtcggttcgtacgacgtccggtacccgaggaccgacgggaccggccgtaacggtactaccggtaccttggacccttaggttcggaacgaacggttacggacggtaaccgtaacgaaaacccggaaaaagtaaagtttacggttacgttaacttttaacggttaaccggaaaccaaagaaccgaccgaccggaaccggtacccggtccgggttacccgttaggttacggttaggtactaacgtttaaataacggtaactaaccggagtacggaccgtaccggacctaggaacgacgttaccgtaccgtacggacgtacgtttctccgttcggtaccgtacgtccgtacgtacgtcggacggacgtacgacggttaccgtaccgttacggttacgtacgttagtaccgttagaacgttacggaccgaggacgaacggacggcggtacgtaacgtaagtacttaacgttactacggaaacttacgggaaccgaaggttaacgtacgggtacggtttaacgacgttttagttacggggttaccgggtcggttaaaccggggacggtaaagggaccggttaacgggtccggttaaaacccccggttcgggttaaccggtaacccggggttcccgaaaccccggggttaacccggtaccccgggtttcccccggttaaacccgggtccccccggggtttaccc

SEQ ID NO: 175513 - DNA, 706 bp, Homo sapiens
  misc_feature: GYAE6OF01BXHAD.21.2.A02.1.454.CMB.1.raw
  modified_base (174)..(174): a, c, t, g, unknown or other
  misc_feature (174)..(174): n is a, c, g, or t
  modified_base (189)..(189): a, c, t, g, unknown or other
  misc_feature (189)..(189): n is a, c, g, or t
  modified_base (265)..(265): a, c, t, g, unknown or other
  misc_feature (265)..(265): n is a, c, g, or t
tcagtcgtcgctcgcacgaccggtgctcgatttagactcatctacgagggaaagggggtgggtccaggaggcagaactcgtgggtgtctcaccatggacctggactcctctacttcctcccctcctcactctctgcacaggctctgacggcctcgtatgacgtctagaccaacncgaccaccgtggtancagtctaccgaggcaaggccgtcgaagatccacgtgctcgtacgactagtagtcgactacgaaacaaaagtaagtntaggtacttagtacgaacctaaacgacgaacgtaccacggaccgacggcccctaggttacgttacgtagtaacgtaacgtaacgtaacgactacgtaggaacggtaccgaccgtacgaacggactaaccgtaccggtacgaacggtcgtaacgttccggtcgtagggtaccctaccgtacggtccgtaacgacgggtaacgacgacgtactacgtacgtacgtaactagtacggtacgtaacgacgtaccgagaacgtagacggacgacggtactacgtaactctaacgtcgaagtaacgacggaatacgggaataccggtacgtagtacgtaggtttcgggacgttcggggaaactacggggaactaacgcggttacggtaacccgtaggttaccccgaagggtacccaccgtaccggtacctccccgggtcgtaaccgg

SEQ ID NO: 175514 - DNA, 911 bp, Homo sapiens
  misc_feature: GYAE6OF01B3PHR.21.2.A02.1.454.CMB.1.raw
tcagtcgtcgctcgcacgaccggtgctcgatttagactcatctacgagggaaagggggtgggtccagggaggcaggaactctgggtgtctcaccatggcctggatccctctacttcctccccctcctcacctctctgcacagggctcgtgacggtcctctagtgacgtcgtagaccactacgccctacccgttgggtgtcctaacggtccgtaccccaagggaccacgggaaccgggccaaggacgtcccaaccgtggtcccttatccggagaacggtcggtcggaaccttcgaaaaaccgaaaagtaagttctacgggttacttttaacggtacgtaaacccggtaaacgaacggtaaccggaccggaccggacccggtacgtccccgtggttaacggtagttagtaaacttagtaaaacgtaacgtacgtaggaccgtggaacccggaccctagggtaacgtacgtaaccctaccggtagggtaccgtaccgtttacgtccgggtttaagtacccggtacccgtaaccgtaaccgggttccggtaaaccggggaacggtacaccgggggtttaaacctggtaaacccccggtttaggtaacccggttaaccgttaaccgttaaccgggtaacgggttaaccggtaaccggttaaacccgggaggtaacccgggaagggaaaccggtaaccggttaaggaccgtttaaaccgtaacgtttaccgttaaacgtaacggtttaaacccgaaagttaccggtaaagacggtaaacgggttacgaaggtttacgtacggttaggtcgggttaacggtaccgggaaccgggtacggtaacgtacgtacggtaaacggtccgttacggtaggacccgtaacggtacccggtacggaccgtcccgtccggtaacccg

SEQ ID NO: 175515 - DNA, 845 bp, Homo sapiens
  misc_feature: GYAE6OF01BRON8.21.2.A02.1.454.CMB.1.raw
  modified_base (132)..(132): a, c, t, g, unknown or other
  misc_feature (132)..(132): n is a, c, g, or t
  modified_base (137)..(137): a, c, t, g, unknown or other
  misc_feature (137)..(137): n is a, c, g, or t
  modified_base (141)..(141): a, c, t, g, unknown or other
  misc_feature (141)..(141): n is a, c, g, or t
tcagtcgtcgctcgcacgaccggtgctcgatttagactcatctacgaggggaaagggggtgggtccaggaggcagaactctgggtgtctcacatggcctggactccctctacttcctcccctctcactctcngcacngctntgacgcctcgtatgagctgaacacgcgcccctaccgtcgggtcgtaccaggtccgtacccgaggaccacggacggaccgtaggactccgtaccgtgccttgcggacaacggagtaccggtacaacgaaaccgtaaaagtaaacttgtacgttacgtttaacggttaacggaaacctaaacggaaggaacggtaccgaacgggaccgtaccggtacccggttgttacgggttaagtaacggtaaattaacgtaaaacgtaacgaaccgtaacgtaggaacggtaaccgtcccgtaagaacgtacgtaccgacgtacggtacgtaccgtacgttccgtcgtacggtcctaccgtacggacgtccggaaacgggactaaacggtcgtaacgtcctaggtaacgtacgtacgtacggtaacgtacggtaacggtacggaacgacgggaacgagggtacggtacggtctaaacggtacttaacgtttaacgaacgtaaacggtaacggtaacgtaacggtaacggtaacgttaacggttaacggttaacggttacgggtacgggtttaggggtacccgggttaacgggggtaccgggaacggttaccggtaaacggtacccgtttaaccgggacccgttaccggggtaaccgtaccggtaccccggaccgggttaacccgtccccggttaaccccggtcccgtaaccgg

SEQ ID NO: 175516 - DNA, 792 bp, Homo sapiens
  misc_feature: GYAE6OF01DG4WN.21.2.A02.1.454.CMB.1.raw
  modified_base (86)..(86): a, c, t, g, unknown or other
  misc_feature (86)..(86): n is a, c, g, or t
  modified_base (139)..(139): a, c, t, g, unknown or other
  misc_feature (139)..(139): n is a, c, g, or t
  modified_base (320)..(320): a, c, t, g, unknown or other
  misc_feature (320)..(320): n is a, c, g, or t
  modified_base (391)..(391): a, c, t, g, unknown or other
  misc_feature (391)..(391): n is a, c, g, or t
  modified_base (472)..(472): a, c, t, g, unknown or other
  misc_feature (472)..(472): n is a, c, g, or t
  modified_base (774)..(774): a, c, t, g, unknown or other
  misc_feature (774)..(774): n is a, c, g, or t
tcagtcgtcgctcgcacgaccggtgctcgatttagactcatctacgaggggaaagggggtggtccaggaggcagaactcgtgggtntctcaaccagtggcctggactccctcgttacttccctcccctctcactctcgngaccagcggcctgtaggaccgtcccttacgttagcggagcctacggaaccacgaccgtccccgtacccgttgggttactccgacggttacccgcccgaaggaccgtaccgggaccggacgacggtctccggtacctgccttcggcgtacgagtacgtcgaacacggtaaactaaagcgttntcgttacgttacgtaaccggaacaagacgacgtccgaaccgtcggtactccggttagttacgtaacgttanaacgttaactaacgtaacgcttacggaacgggtacgacccttagacgaacgtacggtaccaagtgtaccgtcttacgttcncggtacctccgaacggttcaccggtggaaccgcgtaacgtcggtagttcgacgttacgagtacgtacggacgttacggacgtggtaacgacggtacggaacggttacgacggtttaacaaccgggtttattaccgtaacgttaacggacccgtaaggttacccgtaagtaacgggaacgtttaggtaccgttagttacggtacggggttacgttacggggacggtaaccgggtaagaccccgttggtacccggaacggttcccggaggtacccgtacgtacccggaccgtaccggttacccnccggggttccgttacccg

SEQ ID NO: 175517 - DNA, 1010 bp, Homo sapiens
  misc_feature: GYAE6OF01BE5RW.21.2.A02.1.454.CMB.1.raw
tcagtcgtcgctcgcacgaccggtgctcgatttagactcatctacgagggaaagggggtggtccaggaggcagaactcgtgggtgtctcaccatggcctggactccctctacttcctcccccgtctcactctctgccacgaggtctactgacggtccttctaatgagtctgaaccacgacgaccctacccgtggtgtcgaggtccgtcccgaggaccacggaccggtacacggactaccaccgtttggaccttcgtacgacacgtagtcgggaacctacggaaaactaaaaggtaaattactacgttaccgtttaacgttaacggttaacccgaaacgtaacggaaacgaccggtacggacccgtaccggtccccgttaggttacggtttaagtacggtaattaacgtaaagtaacgaacgtacgagggacggtaaccgacccgttacgaagtacgtacgtacccggtaggaccgtaccgtaacgtttccgtacggttaccgaccggttaacccgtaacggtacccgtttaacgggaaacgggggttaacccctacggtaaccggtaccgttaaccggtttaaacccgggtttacgttaaaccggtttaaccggttaaaacggggttaacggttaaccccggttaaacggggttaaccccggtaaacggggttaaccgggaaaaagggggggttaaacccggaacggggttaccggttaaacccggttaagggtttaaacccttaaccgggttttaaaccgtaaccggtttaaaaccgtaaaacgttaacgggttaacggaaacccggtttaaacgggttaaaggttaacgggtttacccgtaaggggttttaggttaaccgggttaccgggggttacggtaccgggggtaaacgggaccgtaaaccgggttccgtaaacccgggttccgttaaaccgggtcccgggaaacgtaccccggggtaaccgaacccgggttaccccgccccgggttaaccggttaaccccggg

SEQ ID NO: 175518 - DNA, 881 bp, Homo sapiens
  misc_feature: GYAE6OF01CMRUS.21.2.A02.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagactcatctacgaaggggaaagggggtgggtccaggaggcagaactctgggtgtctcaccatggcctggactcctctacttctcccctctcacttctctncacaggctcgtgacggcctctatgagctgacacacgcctacccgtggtgtcaggtcgtacccaggacaggacgccaggactcaccgtgctcgtgcagtacgtaggaacttagaacctaaaaggtaaactagtacgtacgtttaagttaccggtaaaccgaaaccgaaggaaaccgtaccgtaacgggtacccgtaccgggtacccccgtttaggttaggtttaacggtaggttaaacttaaacgttaaaacggtaaaacggaaccctacggtacggaacggaccggtaccctagaacgtacgtactacccggtagtacggtccgtaacgtttccgtcggtaccgggtaccttaccgtacggtaccgttaccggaacggggactaacggggtacctaacgggttaccgtaaacggtttcgaaaccgtttaacggtaccggttaaagggttacgtaaaccggtttacccggaagggttaaccgtaaaggggtaaccgggaaccgtaagggtacccgttaaggtaaacccgtttaacgtttaccgtaacgttaaaaccgtaaacggttaacggggtaacgtaaaccgggtaacgggtaacggtaaccgggttacttaacgggttagggttaccgggtacggttacggggaccgggtaacggaaccggtaacggttccgttacggtaccccgttacgtaacggacctaccggtacccggtaacggtcccgttccccgggcccgttacccgg

SEQ ID NO: 175519 - DNA, 490 bp, Homo sapiens
  misc_feature: GYAE6OF02FUN1B.21.2.A02.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagactcatctacagggggctgtgggctcaggaggcagagctctgggaatctcaccatggcctggacccctctcctgctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctcagagatccctgagcgattctctggctccagctcagggacagcagtcacgttgactatcagtgaagtccagcagaggacgaggctgactattactgtacaaacagtagacagtagaggtactcgattgggtagttcggngggaggacaagcgtagaccgtctaggtcacgcccgaggtcccg

SEQ ID NO: 175520 - DNA, 266 bp, Homo sapiens
  misc_feature: GYAE6OF02IH2KE.21.2.A02.1.454.CMB.1.raw
  modified_base (246)..(266): a, c, t, g, unknown or other
  misc_feature (246)..(266): n is a, c, g, or t
tcagtcgtcgctcgcacgaccggtgctcgatttagactcatctacgaggggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacgactgagcgggctggcaaggcgcatagnnnnnnnnnnnnnnnnnnnnn

SEQ ID NO: 175521 - DNA, 571 bp, Homo sapiens
  misc_feature: GYAE6OF02HGV1J.21.2.A02.1.454.CMB.1.raw
  modified_base (286)..(286): a, c, t, g, unknown or other
  misc_feature (286)..(286): n is a, c, g, or t
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctactagggtaaaggggggtgggtccaggaggccagaacctcctgggtggtctcaccatggcctggatccctcgtaccttctccccctcctcgactcctcgtgcacgaggctcgtgaggtcctcctatcgagctggacacagtcccacccgtcgggtgtacagtggtccccccagggaccgagacgggcccaagggactccgaccccttggcctctgctacgactcggacctgaccaaagaaatntgcttattggtaccaacagagaccaggccaggcccctgtcgttagtgatatataaagacactgagacggccctnagagatcccctgagcgattctctggctccagctcgagggacagcagtcacgttgactactnagtgaacgtcgaggcaggacgacgagcgtagacgttatactgacaacagtaagacgagtaggagtactacgtagtggtgtcgggcggaggtaccgagcgtacggaccgtcgtacggtcgacggcccgaaggtccgtccgtccccgtccgg

SEQ ID NO: 175522 - DNA, 648 bp, Homo sapiens
  misc_feature: GYAE6OF02GW8K0.21.2.A02.1.454.CMB.1.raw
tcagtcgtcgctcgcacgaccggtgctcgatttagactcatctactaggggtaaaggggggtgggtaccaggaggcagtaaacgtcctggggtcggtacctcaccgaatccggcctggatccctcttacttctccccctcctcactctctgcacaggctctgaggcctactatgagctgacacacgcccacccgtcggtcgtcagtgtccccaggaccaggaacggcaggactcacctgctcgtcgcagatgggacttggcccaaaaggaaattagtcgtacgttaacttggtacccaaacacgaacgccgacggccaacggccccctggtcgttacgtcgaattaatagtaaacgacactagacgacggcccgtcagagtactccctagacgcgtattcgtcgtggctccgagcgtcgagggacacgctacgtcacgttgactagtcagtcgaagtccgaggcaggacggacgtaggtctagtaactttagttactgtaaccaaacgtagtaagtaactaagtacggtacggttacctacgtacgtttgggttacgttcggggacgggacgggtaccgtaaggtcgtacggaacccgttaccgtaaggtaccgacggtacccgaaggtccgtaccgccccgttacgg

SEQ ID NO: 175523 - DNA, 632 bp, Homo sapiens
  misc_feature: GYAE6OF02G61TD.21.2.A02.1.454.CMB.1.raw
tcagtcgtcgctcgcacgaccggtgctcgatttagactcatctacgaagggaaaggggtgggtccaggaggcagaactctgggtgtctcaccatggcctggatcctctacttctccccctcctcactctctgcacaggctctgaggcctcctatgagctgacacagcccaccctcggtgtcagtgtccccaggacagacggccaggatcacctgcgtactgcagatggactgaccaaagaatgtcgcttattaggtaaccaacaaggaacgccgacggccaggcccctggtcgttggtcatccatgaggacgaggacgacgacccgtccgggactcccgtgagacgtattccgtcgtcggtctaccaactcggaacgggacggtcggacctaacggttgtacttccgtacgtaggtcgggggacccgaggggtcgggaaggtagtggaacggtctacggtaacttacgtacgttggtttactcgacgacgagacgagtacgtaggtgtcgagttcggaggggtctaggttcggacggggacggacgtacggttaccgaccggttccggtacggtccgaccgacccgaacggtcccgtcgtcccccgtcggtccctaccgttccgttccccgg

SEQ ID NO: 175524 - DNA, 878 bp, Homo sapiens
  misc_feature: GYAE6OF02HJ9YR.21.2.A02.1.454.CMB.1.raw
tcagtcgtcgctcgcacgaccggtgctcgatttagactcatctactagggaaaggggtgggtccaggaggccacgaacgttcctgggtgtctcacctagtggcctggatccctctacttctccccctcctcaactctctgcacgaggtcgtctgaggcctcgttactgtagctgtaacacacgccacctcggtgtcagtcgtccccagggacaggtaccggccggagggactcgacctgccgtcggtcgcgagactcggacctgaccaaagaatctgtcttaattcggtaacctaacaggtaaacgtaccagggaccctaacggtccccctggtacggttacggtcgaacgttaagtaacttaaaacggacggaacgtaggaaggaacggtcccttacgaacggtaacggtacgttaccccgtaaggtaacggtacgtaacgtttaccgtaacgttacgggacctttaccgaacgttccgttaacggaaacgggtaacctacggtacgtaaacgggttaccggtaaccggttttaaggaaaccgtttaacgtaaccgtaaacgggtttaccggtaaaaccggttacccgggaaaacgggtaaccgtaaacggggaaacggggtaaaccggacgggttacccgttaggtaaaccgtttaaccgtttaaccgttaacggtaaccgtaaaaccgtaacggttaaccgaacgtaaggtaacggtaacggttaaccgtacggtaaggttacggggtagtttaccggggacgggttaacgggtaacccggtaaggccggttaacggtaacccgggttaccggtaacgggttaccgtaaccgggacccgtaacggggtccgttacccgggcccccggttacgggg

SEQ ID NO: 175525 - DNA, 295 bp, Homo sapiens
  misc_feature: GYAE6OF02HY99G.21.2.A02.1.454.CMB.1.raw
  modified_base (151)..(151): a, c, t, g, unknown or other
  misc_feature (151)..(151): n is a, c, g, or t
  modified_base (260)..(295): a, c, t, g, unknown or other
  misc_feature (260)..(295): n is a, c, g, or t
tcagtcgtcgctcgcacgaccggtgctcgatttagactcatctacgagggggaaagggactggacgtggttatttagttcctcggggccagggtaaccctggtaaccgtctcctcagcctccaccaagggcccatcggtcttcccctggcnccctgctccaggagcaccttccgagagcacagcggcctgggcctgcctggtcaaggactacttcccgtgtctctacgtggacgcggggactgggcgaacggcgcatagnnnnnnnnnnnnnnnnnnnnnnnnnnnnnnnnnnnn

SEQ ID NO: 175526 - DNA, 1008 bp, Homo sapiens
  misc_feature: GYAE6OF02H38VD.21.2.A02.1.454.CMB.1.raw
tcagtcgtcgctcgcacgaccggtgctcgatttagactcatctactaggggaaagggggtgggtccaggagggctacgtaacgtctgggttaggtctcaccatggctggatcctctacgttcgtcccctcctcggactcttcgtgcacagggctcgtcgaggcctcctatcgagctcgacacctacgccgacccttcggtagttcagtcgtacccaggaccagcggccaggacgtccacctagctcgtggacgacgagtgggtacgtcgaccaaaaggtaaattagtggacttaagttgggtaacccaaacgtaagaacgtaccgaggccgaacggtccccctggttggttaacggtcgatttaactaactaaaacggaccaaccgtaggaacggtaacggacccccgtacaaacgggaacgtaccgttacccccgtaggtaacggtccgtaacgtttcccttaacgttacggggacctacccgtaacggtccgtaccggaacggggtaacgaaacgggacctaacgggtcccgttaaacggttttacgtaaccgtttaacgttaccggtaaacggtttaaacccgggtaaaccgggtttacccggacgggggtaccgaaacgggggtaacggggtaaaccgggtaaacggggttacccggtttttacggtaaaccggttttaaaccttttacccgggttaacggggttaaacccgtaaaaacccggggttaaaccgggtttaaaaccgggaaacccggttaaccgggtttaaacggtaaccgggtttaaaccgttacccgttaaacgggttttaaccgggggttaccggggttttacccggggtaccgggggtaacccggggggtaaccccgttaaacccggggtcccgggttacccgggttaacccccgggtttaaccggtaaccgggggtttacccgaacccggggtaccccggtaaaacccggggttcccgttaccccgggtaccccccgggttaaccccgggg

SEQ ID NO: 175527 - DNA, 584 bp, Homo sapiens
  misc_feature: GYAE6OF02G0YFM.21.2.A02.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagactcatctactagggaaagggggtgggtccaggaggcagaactcgtgggtgtctcaccatggcctggatccctctacttctcccctcctcactctctgcacaggctctgacggcctcctatgagctgacacagtcccaccctcggtcgtcagtcgtccccaggacaggacggccagggactccacctgactctgacagatggactgacctaaagaactctgtacttattacggtaccaacgagtaacgaccaggccaggcccctgtgttagtgatatataaagactactgacgacggccctnacgtacgactccgtagacgcgtacttctcgtcggctaccgacgtctcgaggacagctacgtcacgttcgactactcgagtacgacgtcgaggcaggacggacgaggtctagactagtactagtactaacgtagtacgacgtagtagtacgttacgtcgtagttcgggtagtccggacggtacggtaccgaagtcgtacgaccgttccgtagtccgacgtaccgtaggtcctccggtacccttaccgg

SEQ ID NO: 175528 - DNA, 289 bp, Homo sapiens
  misc_feature: GYAE6OF02JJ535.21.2.A02.1.454.CMB.1.raw
  modified_base (248)..(248): a, c, t, g, unknown or other
  misc_feature (248)..(248): n is a, c, g, or t
  modified_base (250)..(252): a, c, t, g, unknown or other
  misc_feature (250)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (271)..(289): a, c, t, g, unknown or other
  misc_feature (271)..(289): n is a, c, g, or t
tcagtcgtcgctcgcacgaccggtgctcgatttagactcatctactagggaaagggactggagtggttattattcctgggccagggaaccctggtaaccgtctcctcacgcctccaccaagggcccagtccggtcttccccctggcgccctgctccaggagcacctccgagagcacagtcggccctgggctgcctggtcaaggactatccctgtactctaactgagcgggctggcaaggcgtcatagncnnngntnanttatctggctnannnnnnnnnnnnnnnnnnn

SEQ ID NO: 175529 - DNA, 764 bp, Homo sapiens
  misc_feature: GYAE6OF02INYEN.21.2.A02.1.454.CMB.1.raw
tcagtcgtcgctcgcacgaccggtgctcgattttagactcatctacgagggaaagggggtgggtccaggaggcagaactctgggtgtctcaccatggcctggatccctctacttctcccctcctcactctctgcacaggctctgacggcctcctatgagtctgacacacgccaccgtcggtgtctagtcgtcccgaggacgaggacggccgaggactcaccgtgctctcgcagatggactcgaccaaaagaatatcgtactttagttacggtaaccaaacgtagaacgaccgacggacccgaacggtcccccgttggtttacggtttaaggtacggtaacttaaacgttaaacggttaaaacggaccgtaacgttaggaacggtaccgggtacccgttacgaacgggtacgtacgttaccccgttaggacggtaccgttactttccgttacgtcggtaccctccgtaacgtccgttacggaacggggacctacgacgacgttaccgtacgtttacgaacgtacgttacgaacgggttacgtaaccggcgtaacggacgtaacgggacggaacggtggtacgtacggtaacttaacgttacgtacgtaaccgaaacgtacggtaacgtacgtaaggttaacgtacggttactacgttaggtttagggttacgtacgggacgggtacggaacgtacgtccggttaccgtaccggttacgaacggtccgtaaccggccgtaacgggcctacccggttcccgtaccgg

SEQ ID NO: 175530 - DNA, 681 bp, Homo sapiens
  misc_feature: GYAE6OF02IWONU.21.2.A02.1.454.CMB.1.raw
tcagtcgtcgctcgcacgaccggtgctcgatttagactcatctacagggaaacgggggtgggtccaggaggcagaactctgggtgtctcaccatggcctggatccctcttacttctccccctcctcactctctgcacaggctcgtgacggccctcctatgagctgaacacagccacccgtcggtgtcgacgtcgtccccgaggacaggacggccaggactccaccgtgctcgtgccagagtcggactgaccgaaaagaaattagtgtcttaagttacggtaaccaacgaaggaacgaccgaacggacccgaccggtcccccttaggttacggtttagtagtaattaagttaacgtaaaacgactacgtggaacggtacggtcccgtacgaggacgacgtcccgtagacgtccgtactttcctcgtcggcctaccgacgtccgtacggacggacacgctacgtcctacgttcgacctatacgaggtagaacgtccgaggcgagggacggacggacggacgtacgtaacttattacgtcgaacaaacgtagtaacgacgtagtaggtacgtaccttgtaggtttgggcgttcgggacggtaacgggtaccgaaggtaccctacggtaccggttaccgtaggtaccgaccggtaccgacgggtcccgtacccggccccgtacgg

SEQ ID NO: 175531 - DNA, 716 bp, Homo sapiens
  misc_feature: GYAE6OF02FFWAN.21.2.A02.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
tcagtcgtcgctcgcacgaccggtgctcgatttagactcatctacgagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgcctntgcagatggactgaccaaagtaaatatgacttattggtaccaanagaagccaggccaggcccctagtcgttangtatataataaagacactgagacggccctagagacgagtccccgtagacgtcgtatttcgtccgtggcctccgagtacctacggaacgggacacggtcccaaggttaccacggttacgaacgttacgacgtagaacggtaacgtaccggaaggacggtagggaccgggaaccggtaggtacgtacggtaaccttaacgttacgtacgtaaccgaaaacgtaggttaacgaacgtaaagggttaacgtaaccgggtttacgaaccgtttacgggttacggggttacgggttaccgggggacgggaaccgggtaaccggaaacggtccggtaaccgggttacccggtaccggttttaaccgggacccggaaccgtaccccggttaacgggtccccgtaccccgggtaccccggtttaaccccggg

SEQ ID NO: 175532 - DNA, 718 bp, Homo sapiens
  misc_feature: GYAE6OF02F88SN.21.2.A02.1.454.CMB.1.raw
tcagtcgtcgctcgcacgaccggtgctcgatttagactcatctacagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaggactcacctgctcgtggagtattcattcgaaccaaaaagtatattacgttgttggtccagcagaagtcaggccacggcccctgtactggtcatccatgagccagtcgacgacacgtccggactccctagacgagtacttcgtctcgcccttcgagtcctacggaacgggactaggtcggacccttaccgttacgaacttacgtccggtagggtccggggaccccgagggtacgggaacgtagtacggaacgtccgtacggtaaccttacgttaagtttacggtaacccgacgtaacccgtaaggtaacgtaacggttacggtacggttacgaacggttacggggaacgggggtttaacgttccgggggaacggggaaccggggtaacccgttaagggttacccggtacccgggtttccggttacggttacccggaacgggttacccccgaacgggtcccgttaccccgggtacccccggtttaccggtaccccgttacccgttccgttaccccccgg

SEQ ID NO: 175533 - DNA, 1036 bp, Homo sapiens
  misc_feature: GYAE6OF02GEWX9.21.2.A02.1.454.CMB.1.raw
tcagtcgtcgctcgcacgaccggtgctcgatttagactcatctacaggggtaaagggggtcggtccaggaggcaggaaactcctgggtacgtctacaccagttggtccctggtatccctctacgttctcccctcctcaactctcgtcgctacaggctctagtaggcctcgtagtcgacgtcctgtacgtactaggcctacccgtcggtacgtcgtacgtcgtccccaggacgacgtacggtccaagggtacgttcggaaccctcgtccttcctaggacctagggttacgtttccgggaacggttcggtacccggtaaaaacggtaaaccttaggtccgtaccgtttaaggttaccggggtaaacccctaaagaacgtaaacgtaccctaaacggggtacccctaaacggggttccccccttaggttaacggtttaaacgggttgggtaaacgtttaaaccgtttaaacggttaaaaaaccggaccgttaaccggttcggaaaccggtaacgggaccccgttacgtaacggaacggttaccgtacccccgtaggtaacgtccgtaactttacgtaccgtacgggtacctaccgaacgtacttaccggaaacggggtttacccgaaggaccgtacggtttaccgaagggttttacgtaaccggtttacgtacccggtacgttacggtaaacggttaccggaacggggtacttaaacgggaacgggtaacggtaacgggtaccgtacggtaaaccgtttaacggttaaccgttacggtttaaaccgtaaaacgttaaggtttaacggtaaacgttaacggggtttaaacgttaaacgggttaaaccgttaccggttaaacggtttacgggggttaccgggtttaccgggggtacgggttaacccggggtaacccggtaaagggttacccgtaaacggggttaaccccgtttaaccggtttaaccgggtacccgttaccgggttaaccccgggtaaccgggtttcccgtttaccccgggtaccccccggttaacccgggg

SEQ ID NO: 175534 - DNA, 772 bp, Homo sapiens
  misc_feature: GYAE6OF02IERAU.21.2.A02.1.454.CMB.1.raw
  modified_base (194)..(194): a, c, t, g, unknown or other
  misc_feature (194)..(194): n is a, c, g, or t
  modified_base (236)..(236): a, c, t, g, unknown or other
  misc_feature (236)..(236): n is a, c, g, or t
tcagtcgtcgctcgcacgaccggtgctcgatttagactcatctacagggaaacgggggtaggtccacggaggcgagaactcctgggtgtctcaccatcggcctggactccctctacttctcccctcctcactcttctgcacaggctctgacggcctccatcgagtcagactacgacgccctacccgttcgggtntaccagttcgtaccccaggacaacggtaccggccgaggtacnccgacctggctcgtggacctagacgtggtacttacgaacctaaaagaattagtggtactttaagttaccggtaaccaaacgtacggacgaccgacggccaacggtaccctggttacgttaggtagtaacttaagtaacgtaaacggtacacgtacggacggtaacggtccctagaggtactactacccgtaggaacgtcgtaacgtttccgtagtccggacttaccgaggtacccaacggacgggacacggtacgttacggactttacgtagaactttacgtacgtaagttacggaaccgttccggaaggtaccgagggaaccggtacgtacggaccgttaacgtacgtttaaccgttagtacgaacgtaacgaacgttaacggaaccgtaagtaacggttaacgttactcgttaaggttcgggttacggtcggaacggggacggttaaccgaacgggttacttaccgggtaacccgttacgtaccggttcgaaccggtacccgtacgggtacccttcccgggccccgtttaacgg

SEQ ID NO: 175535 - DNA, 754 bp, Homo sapiens
  misc_feature: GYAE6OF02JHKK9.21.2.A02.1.454.CMB.1.raw
  modified_base (137)..(137): a, c, t, g, unknown or other
  misc_feature (137)..(137): n is a, c, g, or t
  modified_base (159)..(159): a, c, t, g, unknown or other
  misc_feature (159)..(159): n is a, c, g, or t
  modified_base (233)..(233): a, c, t, g, unknown or other
  misc_feature (233)..(233): n is a, c, g, or t
  modified_base (516)..(516): a, c, t, g, unknown or other
  misc_feature (516)..(516): n is a, c, g, or t
  modified_base (590)..(590): a, c, t, g, unknown or other
  misc_feature (590)..(590): n is a, c, g, or t
  modified_base (633)..(633): a, c, t, g, unknown or other
  misc_feature (633)..(633): n is a, c, g, or t
tcagtcgtcgctcgcacgaccggtgctcgatttagactcatctacagggtaaagggggtgggtccaggaggcagaactctgggtgtctcaccatggcctggatccctctacttcctccccctcctcactctctgcanaggctctgacggcctctatganctgacacgacgccctacccgtggtcgtacgaggttccgaccccgaaggaccaacgggccggaccaagggtaccnccgaccgtcgccttcgtacgaccgaaggtaccgttacgggaccttacggaacctaaaagttaaacgttgttacgttaccgtttagttacggtaaccgaaacgtacggacgacccggacggtaaccgaacccgggttccccttagggttacgtttacgttaagtaacgtttaaataacgttaaacggacctaacggttggaacgggaccggttcccaaggaacggtacgtcccttacccggaaggtaccgtcggttacctttcgtaccggtcgcctacggtacncggtacggtaacggcacggtaccgtaccgttcgtaacgttacgtacttaccgtagtcggtaacgtacggaccgngaacgtacgacggacgcggtatacgtattctagtcaagtacgngtacaagtagagtaccgtagtcgttacggtaggttcggtacgggacggtacggtaaccggtgtaccgtacggtacccgtcggacgtacgaccgcggtacccgtcgtcccgtaccgtacccg

SEQ ID NO: 175536 - DNA, 673 bp, Homo sapiens
  misc_feature: GYAE6OF02JKQFO.21.2.A02.1.454.CMB.1.raw
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (183)..(183): a, c, t, g, unknown or other
  misc_feature (183)..(183): n is a, c, g, or t
  modified_base (215)..(215): a, c, t, g, unknown or other
  misc_feature (215)..(215): n is a, c, g, or t
  modified_base (328)..(328): a, c, t, g, unknown or other
  misc_feature (328)..(328): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
  modified_base (652)..(652): a, c, t, g, unknown or other
  misc_feature (652)..(652): n is a, c, g, or t
tcagtcgtcgctcgcacgaccggtgctcgatttagactcatctactagggaaacggggtagggtccgacggaggcgaggaactctgggtgtctcaccatggcctcggattccctcctacttctcccccctccttccacttcctctgcacaggctctgacggcctcctntcggancgtgacacngccctcccgtcggttgccagtacggtcccccnggacgacaacgggccgacgttcgaccacctgcttcgcgtcagagtagccgtacgtaccaaaaggtaatacgttcgactttagttggttaaactcgaaccagaagccacggacnccggaccctgtacgttgatagtactaataacggtanacttaggagtacgggccctanaacgacgtactaccgagtcgactacttacttcgcgtacctcacggttccagaacgggactacgactaancggtaccgtanaccctanacgtagtcgaaacgtacgacgagtacgacggtagnggtactagaccgtataaccgtcgaaacgaacgttacgtaaagacctagggtaaccggtacttaaggtcgtaagggtttaccgagtttcgggaaggaccgtcgggtaaacgtgacccggtaacgttccgaggttaccacgaacggntacccggtccgttaaccccgg

SEQ ID NO: 175537 - DNA, 866 bp, Homo sapiens
  misc_feature: GYAE6OF02HJ8XM.21.2.A02.1.454.CMB.1.raw
  modified_base (529)..(529): a, c, t, g, unknown or other
  misc_feature (529)..(529): n is a, c, g, or t
tcagtcgtcgctcgcacgaccggtgctcgatttagactcatctacgagggaaaggggtggtccaggaggcagaactctgggtgtctcaccatggcctggatccctctacttctccccctctcactctctgcacgagctcgtgacggtcccttcctagtgacgctcgaacaccgacgcccctacccgttcgggttagtacgacggttcccgaaccccgaggtaacgaacggtccggtaccgaggtacttaccacccgtgccgttacctgggacctacggtacttcggggtactaccgtaaaacgaaaagttaaagtcgtttaggttaccttaaggtttaccgggaacctaaaccggaaggtaaccgtacccggaacggccccggtaacccggttacccccgttagggttattacggtagttaaacgttactaaacgtaaaacggacctaacggtcggaacggtaccgtcctaacgaacggtacgtaccgtacgtacggaacgttcgtactttccgaccgtgtaacccgtnacggtaccgtagggaacgtcgacggttccggtaacgtaccgtttgtaaccttacgttacgtacggtaagtacgtaccgtacgacggtacgaccggggtaaggtaccgggtaagtccggttaacgtaaccgtttaactttaacggaactaaccggttaaagtaacgggtagtaaccgggagttaacccggggtaacttacggttagttaacgggtttgggttaccgttcggggacgggtaacgtaccggtaacggtcggtacgggttacccttaccggacggttaccggacccggttaacccggaacggttccccgtacccgttcccccggtaacccg

SEQ ID NO: 175538 - DNA, 767 bp, Homo sapiens
  misc_feature: GYAE6OF02GOHEO.21.2.A02.1.454.CMB.1.raw
  modified_base (193)..(193): a, c, t, g, unknown or other
  misc_feature (193)..(193): n is a, c, g, or t
tcagtcgtcgctcgcacgaccggtgctcgatttagactcatctacgagggaaaggggtggtccaggaggcagaactctgggtgtctcaccatggcctggactccctctacttcctccccctctcactctctgcacgaggctctgacggtcctctagtgacgtctagacacacgtccctaccgttggtgtacgngtccgtaccccgaggacgacgtaaccggccgaggtactccaccgtcgtccgttcgtacgaccgaagtacgtacggacgtacgaaccgtaaaagtaaagttctacgttaacgtttacgttaaccggacctaaaacgaggaaccgacgaccggccgtaaccggtcccgttagtacggttaggtctaattaagtaaacgtaacgtacgaacgtgggacgtaaccggtacctagaacgaacttccgtaccggtagtaacggtaccttacgtttcgtaccggtaaccggtcctaccggtacgtaccgtaacggacgggtaacaacggtacgttaccgtacgtaacgttacgtacgtagtacgtagtacgtacgtcgaacggacgacggacggacgtgtacgtacgtactacgttaccgtagtaacgaacgggtactaacgtgttaacgacgttaagttcgtaggtacgtttggggaccgttacgggacgtacggacgtaaacggtaccgggtcgttaaccggacgttcgtaaccgggttccaaccggtcccggtacccggttcccgtacccggttacgg

SEQ ID NO: 175539 - DNA, 313 bp, Homo sapiens
  misc_feature: GYAE6OF01DUIS9.13.28.C06.1.454.CMB.1.raw
  modified_base (309)..(313): a, c, t, g, unknown or other
  misc_feature (309)..(313): n is a, c, g, or t
tcagtcacgtactacacgaccggtgctcgatttagagctcacgtattgggtttgggatagaaagcggccctcagggatccctgagcgattctcaggctccaattctgggaacacagccactctgaccatcagcgggacccaggctatggatgaggctgactattactgtcaggcgtgggacaacaacactgcgattttcggcggagggaccaagctgaccgtcctaggtcagcccaaggctgccccctcggtcactctgttcccgccctcctctagtacgtgactgagcgggctggcaaggcgcatagnnnnn

SEQ ID NO: 175540 - DNA, 316 bp, Homo sapiens
  misc_feature: GYAE6OF01B9X99.13.28.C06.1.454.CMB.1.raw
  modified_base (313)..(316): a, c, t, g, unknown or other
  misc_feature (313)..(316): n is a, c, g, or t
tcagtcacgtactacacgaccggtgctcgatttagagctcacgtattgggtttgggatagaaagcggccctcagggatccctgagcgattctcaggctccaattctgggaacacagccactctgaccatcagcgggacccaggctatggatgaggctgactattactgtcaggcgtgggacaacaacactgcgattttcggcggagggaccaagctgaccgtcctaggtcagcccaaggctcgccccctcggtcactctcgttccccgccctcctctagtacgtgacctgagcgggctggcaaggcgcatagnnnn

SEQ ID NO: 175541 - DNA, 1120 bp, Homo sapiens
  misc_feature: GYAE6OF01DNOR9.13.28.C06.1.454.CMB.1.raw
tcagtcacgtactacacgaccggtgctcgatttagagctcacgtattgggtttggggctcagagaggagccttagccctggactccaaggcctttccacttggtgatcagcactgagcacagaggactcaccatggaagttgggctagtaacgttgggttttccttgttgtacttattttaggaaggtgtcagtgtagaagtgctacgtggtggacggtcggggatacgttcggtaccgaggtccggtcgggggtccctaggtacgtaccttcctccgttggtacgtacgtccgttgttggttacgttttttacgttttagtcgtaacttaggtttaggagtttacggtacgggtttaccggggtccccgtaccgtacgggtaccgttacccgggaaaggggggtacggggtccgtagggggtacgggttacgggggtacggaacccctaaaacgtaaagttaaaacgggtaccggtaagtaggtaaacggtttaggtaaaggttaaaacttttaaaggttttacgtttacgggtaacctttcggttagggtaacgggtaaaccgggtcccttaacgttacctaaacccgttaacgttacccggtaaacgggaacccggggtaaacctaaacccggggtaaaccctaaacggttaaaccggtttccggtaacgtttaacggttaaccggtttaccggtaaaccggtaaacggtaaacggggttaccgggtaaaccgggtaccgtaacccgggttaacgggaaacggggttaaccgggtaccccgggtaaaccggtaaaccccggggttaacgtttacccgggtttaaaggtttttaaacgtttttaaacggttttacgggttttacgggtttaacggggttaaacccggttaaaggttaaaccccgggttttaaccgggaaccccgtttaaacccgggttttttaaaaccccgttttaacgggttttacccgggtaaaaacccccggggttttaaacccggggggttaaccccgggggtaaaccccccggggtttaaaccccggggggttaaaccccccgtttttaccggggttaaccccccggttaaaccccggttttccccggtaaaaccccccccgg

SEQ ID NO: 175542 - DNA, 687 bp, Homo sapiens
  misc_feature: GYAE6OF01AY8US.13.28.C06.1.454.CMB.1.raw
  modified_base (547)..(547): a, c, t, g, unknown or other
  misc_feature (547)..(547): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaacttgggttttccttgttgcttattttagaaggtgtccagtgtgaagtgcaccgtgggtgggaggtccgggggagtacgttggtccaggccggtggggggtccctgacgactctcctgtcgtagccttcgtggttattttgttttagtgtacttagttggattggtaggtttcgggtccgccgacggtccgtaccggagggggaaggggcgtaggggaggtggggtcgaccaaagtaagttaaaggtacgaagttacggtaaagttagaaagtaattaaaagtttagtttacggacttcgtaggtaggaacgggtccgtattaccgaacctatccgtacgggaagggaaccaacgacctaaacgacctcgacttagtactcgtagaactaagtcggganacgtcgaggagacgaccgggagaccgaggtctaggttattagttgttggtgtagagtacgttcgcctacttacgttacgttgacgtacgggtcgggaccgtaaccgggtaccttccggtaacctcccgttcctaaccccg

SEQ ID NO: 175543 - DNA, 396 bp, Homo sapiens
  misc_feature: GYAE6OF01DJSND.13.28.C06.1.454.CMB.1.raw
  modified_base (367)..(367): a, c, t, g, unknown or other
  misc_feature (367)..(367): n is a, c, g, or t
  modified_base (369)..(396): a, c, t, g, unknown or other
  misc_feature (369)..(396): n is a, c, g, or t
tcagtcacgtactacacgaccggtgctcgatttagagctcacgtattgggtttgggatagaaagcggccctcagggatccctgagcgattctcaggctccaatttctgggaacacagccactctgaccatcagccgggacccaggctatggatgaggctgacttattactgtcgaggcgtgggacaacaacactgcgtagttttcggcgggacgggaccaagctacgacccggtcctaggtccacgccccgaacggcctccgccccccgttcggtccaccttccttcgttcccccgccccttccctcttacggtaccgttcgactggtaggaccggggtcgtggccgaagggccggaccaagtaggncnnnnnnnnnnnnnnnnnnnnnnnnnnnn

SEQ ID NO: 175544 - DNA, 318 bp, Homo sapiens
  misc_feature: GYAE6OF02F339K.13.28.C06.1.454.CMB.1.raw
  modified_base (315)..(318): a, c, t, g, unknown or other
  misc_feature (315)..(318): n is a, c, g, or t
tcagtcacgtactacacgaccggtgctcgatttagagctcacgtattgggtttgggatagaaagcggccctcagggatccctgagcgattctcaggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaaggcccaacccactgtcactctgttccccgcctcctctagtacgtgactgagcgggctggcaaggcgcatagnnnn

SEQ ID NO: 175545 - DNA, 309 bp, Homo sapiens
  misc_feature: GYAE6OF02FHUTK.13.28.C06.1.454.CMB.1.raw
  modified_base (308)..(309): a, c, t, g, unknown or other
  misc_feature (308)..(309): n is a, c, g, or t
tcagtcacgtactacacgaccggtgctcgatttagagctcacgtattgggtttgggatagaaagcggccctcagggatccctgagcgattctcaggctccaattctgggaacacagccactctgaccatcagcgggacccaggctatggatgaggctgactattactgtcaggcgtgggacaacaacactgcgattttcggcggagggaccaagctgaccgtcctaggtcagcccaaggctgccccctcggtcactctgttcccgcctcctctagtacgtgactgagcgggctggcaaggcgcatagnn

SEQ ID NO: 175546 - DNA, 548 bp, Homo sapiens
  misc_feature: GYAE6OF02F27WI.13.28.C06.1.454.CMB.1.raw
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggtattttgttttagtgactattggatgagttgggtccgccaggctccgaggggaggggctggagtgggtgccaacataaagtacgatgaagttgagataaattattggactntgtgaaggcgattcacatctcgaggacaacgcaagactcgntgtatctgacaaagtggagagcctagagagccgaggacacggctagtatattatgtgtgagtatagcgctaacttactttgacttacgtggggaccaggggtaaccccttgggtaccctaccgtctccc

SEQ ID NO: 175547 - DNA, 698 bp, Homo sapiens
  misc_feature: GYAE6OF02IZZYE.13.28.C06.1.454.CMB.1.raw
tcagtcacgtactacacgaccggtgctcgatttagagctcacgtattgggtttggggctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggtattttgtttttagtgtacttattggatgtaggttgggtccgccgaggctccgagggggaaggggctggggaggtggggtcggaccaaacgagtaaaaggtacgaattgaaaggtttaggaagtaaattaaaatttagtttagggaccttcgtaggttaggaaacgggggtccgtaattaccgaaccctattccgtacgggaacggggaaccaaaccggacccgaaaagtaaaccgtccggtacttaggttaacttcgtacgaacaaaagttgggaaacgtacgccttagggacgacgggccggaagggaccacgggtctagtattattagttggtgtgaagtattacggctacgtaactttacgttaggaaccgttacggcggggacccgtaaggggaccccttgggtacccgtacccggttcctaccccg

SEQ ID NO: 175548 - DNA, 696 bp, Homo sapiens
  misc_feature: GYAE6OF02HIE5H.13.28.C06.1.454.CMB.1.raw
  modified_base (279)..(279): a, c, t, g, unknown or other
  misc_feature (279)..(279): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaactgggttttccttgttgctatttagaaggtgtccagtgtgaagtgcacctggtggagtccgggggagacttggtccagccgtggggggtccctgagactctcctgtgtagcctctggtatttgttttagngtactattggatgaggttgggtccgccaggctccgaggggaagggctgggagtgggtgaccaacgagtaaagtacgagtgaagttgaagaattaaattagttggactcgtgtaggaagggtccgtattccaacctatccgtacgggaacgggacaaaccggccgaaaagaaccgtcggtacttaggtactcgtagactaaagtgggaacgacgtcctaggagacggcccggaagggaaccgtacgggctagttaattagtttaagttggtaagaacgtaaaaagtccttaccccgtaaaccccgtttaggttaacgttttttagggaacggtttacgggttaacgttaacccgggtaagggttcccggggggtaaccgtaaccgggggtaaaccccctttggggtaaccgtaaccgg

SEQ ID NO: 175549 - DNA, 312 bp, Homo sapiens
  misc_feature: GYAE6OF02GF339.13.28.C06.1.454.CMB.1.raw
  modified_base (309)..(312): a, c, t, g, unknown or other
  misc_feature (309)..(312): n is a, c, g, or t
tcagtcacgtactacacgaccggtgctcgatttagagctcacgtattgggtttgggatagaaagcggccctcagggatccctgagcgattctcaggctccaattctgggaacacagccactctgaccatcagcgggacccaggctatggatgaggctgactattactgtcaggcgtgggacaacaacactgcgattttcggcggagggaccaagctgaccgtcctaggtcagcccaaggctgccccctcggtcactctgttcccgccctcctctagtacgtgactgagcgggctggcaaggcgcatagnnnn

SEQ ID NO: 175550 - DNA, 597 bp, Homo sapiens
  misc_feature: GYAE6OF02HELPN.13.28.C06.1.454.CMB.1.raw
  modified_base (303)..(303): a, c, t, g, unknown or other
  misc_feature (303)..(303): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggattttgtttttagtgactattggatgagttgggtccnccaggctccaggggaagggctggagtgggtggccaacataaagtcgatgaagttgagataaattattggactctgtgaagggccgattcaccatctcggaggacaacgccaagaactcgctgtatcgtgacaaagtggaagacgacctggagacggaccgaggggggaccacgggcgtagtacttattagttgtgacaaagtactaccctaaccccgtttacgtacgttttaggaggttaggttacgtaccggtaggtcggggaccgtaacggggtaacccgttggtactacgg

SEQ ID NO: 175551 - DNA, 316 bp, Homo sapiens
  misc_feature: GYAE6OF02IFGXL.13.28.C06.1.454.CMB.1.raw
  modified_base (231)..(231): a, c, t, g, unknown or other
  misc_feature (231)..(231): n is a, c, g, or t
  modified_base (310)..(316): a, c, t, g, unknown or other
  misc_feature (310)..(316): n is a, c, g, or t
tcagtcacgtactacacgaccggtgctcgatttagagctcacgtattgggtttgggatagaaagcggccctcagggatccctgagcgattctcaggctccaattctgggaacacagccactctgaccatcagcgggacccaggctatggatgaggctgactattactgtcaggcgtgggacaacaacactgcgattttcggcggagggaccaagctgaccgtcctaggtcngcccaaggctcgcccctcggtcactctgttccccgccctcctctagtacgtgactgagcgggctggcaaggcgcatagnnnnnnn

SEQ ID NO: 175552 - DNA, 624 bp, Homo sapiens
  misc_feature: GYAE6OF02FGERK.13.28.C06.1.454.CMB.1.raw
  modified_base (266)..(266): a, c, t, g, unknown or other
  misc_feature (266)..(266): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (541)..(541): a, c, t, g, unknown or other
  misc_feature (541)..(541): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaacttgggttttcctgttgctattttagaaggtgtccagtgtgaagtgcacctggtggagtccgggggagacttggtccagccgtggggggtccctggagactctcctgtgtagccctntggtattttgttttagtgtacttattgggattggaggtttgggtcccgccacgggctcccggagggggaagggggctggggaggtggggtggaccaaacgagtaaaagtacgatgtaaggttgagtaattaaatttagtttgggacttcgtgtaggaacggggccgaattccacctatcgtacggagggaccaacggaccaagtactcgtctgtactcgtgacaaagtgganagcctaggngaggccgaggaccaggtactgttaattattagtntgtgagtattgccgtactacttacttacggaaccttacgtcggggacccacggggaaccccttggacccgtccgttcctcccg

SEQ ID NO: 175553 - DNA, 671 bp, Homo sapiens
  misc_feature: GYAE6OF02GSQ4Q.13.28.C06.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
  modified_base (630)..(630): a, c, t, g, unknown or other
  misc_feature (630)..(630): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaactgggtttccttgtgctattttagaaggtgtccagtgtgaagtgcacctggtggaggtccggggganacgttcggtccagccgtggggggtccctggacgacctctcctgtcgcacgtcctctggtacttcaaccttttaggtagcttagttggattgagtcgtgggtcccncgtacggctccgaaggggacggggcgtagggaggtggggtcgaccaacgaagtaaagcgtaaggttcgggaagtagaagaaatactataggtgtactctaggtaggagggacctattccacgtatcctcgagaacgacacgaaccaaagaacctcacttagtatccgtagactaacgtagaaaccgtcgccgtaggaacgtacgacccgggtacggaaccgtccggtacgttcgtaccgtttacgtttacggtaggtcggacgggtaaggaagggtttacgggtacggggggtaacgttaaagggttanaccggtaggtacgggttaccggtacgttacgtttaacccgg

SEQ ID NO: 175554 - DNA, 649 bp, Homo sapiens
  misc_feature: GYAE6OF02I117C.13.28.C06.1.454.CMB.1.raw
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
  modified_base (531)..(531): a, c, t, g, unknown or other
  misc_feature (531)..(531): n is a, c, g, or t
  modified_base (590)..(590): a, c, t, g, unknown or other
  misc_feature (590)..(590): n is a, c, g, or t
tcagtcacgtactacacgaccggtgctcgatttagagctcacgtattgggtttggggctcagagaggagccttagccctggactccaaggcctttccacttggtgatcagcactgagcacagaggactcaccatggaattggggctgaacttgggttttccttgttgcttattttagaaggtgtcagtgtgaagtgcactgggtggaggtcgggggagtacgttggtccaggccggtggggggtccctggacgacttcctccgtgtcgtacgtcctacgtggtatttttggtttttagtgtaaccttagtttggacttggtaggtttcggggtccgaccagggtccttaccggaagggggtaggggcgtaggaggttggggcgaccaaacgtagtaaaacggtcgaagttagtaaggtttgaagtaaattaaatttagttaggactgtggtaggaacgggtctattcaccatcgtacggagggactaacgccaaagacctcggtntagtactcgtanacaaaggtgacganccgtgaacgcggaccgaggaacgacggcgtagtaattgtaagttgtagtgatagtacgngacctattacgttcagttaccggtggaccgacggaaccgtcggactaccgtcgtacccg

SEQ ID NO: 175555 - DNA, 131 bp, Homo sapiens
  misc_feature: GYAE6OF01B74HE.12.23.C01.1.454.CMB.1.raw
  modified_base (109)..(109): a, c, t, g, unknown or other
  misc_feature (109)..(109): n is a, c, g, or t
  modified_base (130)..(131): a, c, t, g, unknown or other
  misc_feature (130)..(131): n is a, c, g, or t
tcagatacgacgtacacgaccggtgctcgatttagtacacgtgattagggattgggcacagcggccctgggctgcctggtcaaggactacttcctacgtcgtatctgancgggctggcaaggcgcatagnn

SEQ ID NO: 175556 - DNA, 130 bp, Homo sapiens
  misc_feature: GYAE6OF01C5IBJ.12.23.C01.1.454.CMB.1.raw
  modified_base (130)..(130): a, c, t, g, unknown or other
  misc_feature (130)..(130): n is a, c, g, or t
tcagatacgacgtacacgaccggtgctcgatttagtacacgtgattagggattgggcacagcggccctgggctgcctggtcaaggactacttcctacgtcgtatctgagcgggctggcaaggcgcatagn

SEQ ID NO: 175557 - DNA, 508 bp, Homo sapiens
  misc_feature: GYAE6OF01BTF1U.12.23.C01.1.454.CMB.1.raw
  modified_base (203)..(203): a, c, t, g, unknown or other
  misc_feature (203)..(203): n is a, c, g, or t
  modified_base (481)..(481): a, c, t, g, unknown or other
  misc_feature (481)..(481): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaaatagcgacttagcctggtaccagcagatacctggccaggctcccaggctcctcatctatggtgcatctaccagggccactggtatcccagccaggttcagtggcagtgggtctgggacaggagttcactctcaccatcagcagcctgcagtctgaagtattttgctagtttattactgtcagcagtataataactggttcctgtctctacgtttcgggcgggggtaccaagggtggagagtanaaacggtactgtggctgcacatctgtc

SEQ ID NO: 175558 - DNA, 548 bp, Homo sapiens
  misc_feature: GYAE6OF01DJBGD.12.23.C01.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
  modified_base (420)..(420): a, c, t, g, unknown or other
  misc_feature (420)..(420): n is a, c, g, or t
  modified_base (538)..(538): a, c, t, g, unknown or other
  misc_feature (538)..(538): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaaggggaaancgcccaccctctcctgcagggccagtcagagtgttaatagcgacttagcctggtaccagcagatacctggccaggcctcccgaggcctcctcattcctagtcggtncatcctaaccgagggccacgtggtactcccgagcctaggttcaggtggctaggtggtctgggacaggtagttcactctcacgtatcagcagcctgctagtctagaagtnttttgcttagtttattacgtgtcagtactagtaataatacgtcgttcctgcttacgacgtttcggggacgggactaagggtgagtactacgaaacggtacgttggagcgtcgactacnttcgtgttcc

SEQ ID NO: 175559 - DNA, 490 bp, Homo sapiens
  misc_feature: GYAE6OF01BU2K1.12.23.C01.1.454.CMB.1.raw
  modified_base (203)..(203): a, c, t, g, unknown or other
  misc_feature (203)..(203): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaatagcgacttagcctggtaccagcagatacctggccaggctcccaggctctcatctatggtgcatctaccagggccactggtatcccagccaggttcagtgcagtgggtctgggacagagttcactctcaccatcagcagcctgcagtctgaagattttgctagtttattactgtcagcagtataatactgttcctgctcactttcggcggggtacaggtggagntacgaacgactgtgctgcacnctctgtc

SEQ ID NO: 175560 - DNA, 493 bp, Homo sapiens
  misc_feature: GYAE6OF01BWAJM.12.23.C01.1.454.CMB.1.raw
  modified_base (203)..(203): a, c, t, g, unknown or other
  misc_feature (203)..(203): n is a, c, g, or t
  modified_base (487)..(487): a, c, t, g, unknown or other
  misc_feature (487)..(487): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccactggtatcccagccaggttcagtggcagtggtctgggacagagttcactctcaccatcagcagcctgcagtctgaagtattttgctagtttattactgtcagcagtataatactgttcctgctctacgttcggcggggacaggtggagatacaacgactgtggctgcaccntctgtc

SEQ ID NO: 175561 - DNA, 130 bp, Homo sapiens; identical to SEQ ID NO: 175556
  misc_feature: GYAE6OF01EX0Q5.12.23.C01.1.454.CMB.1.raw
  modified_base (130)..(130): a, c, t, g, unknown or other
  misc_feature (130)..(130): n is a, c, g, or t

SEQ ID NO: 175562 - DNA, 497 bp, Homo sapiens
  misc_feature: GYAE6OF01BJ4QM.12.23.C01.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (414)..(414): a, c, t, g, unknown or other
  misc_feature (414)..(414): n is a, c, g, or t
  modified_base (490)..(490): a, c, t, g, unknown or other
  misc_feature (490)..(490): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctcagccaccctgtctgtgtctcaggggaaangccacctctcctgcagggccagtcagagtgttaatagcgacttagcctggtaccagcagatacctggccaggctcccaggctcctnatctatggtgcatctaccagggccactggtatcccagcctaggttcagtggcaggtgggtctgggactaggagtttcactctcaccatcagcagcctgcagtctgaagtatttgctagtttatactntcagcagtataatactggttctgtctctacgttcgggcggggaccaggtggagagtacaaacgatgtggctgcacntcgtgtc

SEQ ID NO: 175563 - DNA, 513 bp, Homo sapiens
  misc_feature: GYAE6OF01C2CYH.12.23.C01.1.454.CMB.1.raw
  modified_base (203)..(203): a, c, t, g, unknown or other
  misc_feature (203)..(203): n is a, c, g, or t
  modified_base (399)..(399): a, c, t, g, unknown or other
  misc_feature (399)..(399): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccagtggtactcccagccaggttcaggtggcaggtggtctgggacagtagttcactctcaccatcagcagcctgcagtcagaagtnttttgctagtttatactgtcagctagtataatactggttcctgtctcgtacgttcgggcggggtaccagggtgagtactacgaaacgtacgtggtgctcgacactatctgttcc

SEQ ID NO: 175564 - DNA, 131 bp, Homo sapiens
  misc_feature: GYAE6OF01AIR9E.12.23.C01.1.454.CMB.1.raw
  modified_base (131)..(131): a, c, t, g, unknown or other
  misc_feature (131)..(131): n is a, c, g, or t
tcagatacgacgtacacgaccggtgctcgatttagtacacgtgattagggattgggcacagcggccctgggctgccctggtcaaggactacttcctacgtcgtatctgagcgggctggcaaggcgcatagn

SEQ ID NO: 175565 - DNA, 649 bp, Homo sapiens
  misc_feature: GYAE6OF01B39OS.12.23.C01.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
tcagatacgacgtacacgaccggtgctcgatttagtacacgtgattagggattgggggagaactgctcagttaggacccagacggaaccatggaagccccagcgcagcttctcttcctcctgctactctggctcccagataccactggagaaatagtgatgaagcagtctcagccaccctgtctgtgtctccgagggggaaangcccaccctctcctgcagggccagtcagagtgttaatagcgtacttagcctggtaccagcagatacctggccaggcctcccaggcctcctcatctagtggtncatcctaccagggcccagttggtactcccagcctaggttcaggtggcaggtgggtctgggacnggattccactctcaccatcaggcagcctgactagtctagaagtattttgacttagttttatttaccgttgtaccgagacgtaagttaattaaagttaaccgttcgggtttaccttgggtaccttccgttaaccggggttttccgggggaccgggggggtaaacccgttaaagggggttaggggtaaacggtaacgttaacccgaaaaaccgggttaccgttaggggtaccgggttaccgtttacggacccgtaaacccgtactttcccgttcgtttacccg

SEQ ID NO: 175566 - DNA, 592 bp, Homo sapiens
  misc_feature: GYAE6OF01DONTY.12.23.C01.1.454.CMB.1.raw
  modified_base (202)..(202): a, c, t, g, unknown or other
  misc_feature (202)..(202): n is a, c, g, or t
  modified_base (354)..(354): a, c, t, g, unknown or other
  misc_feature (354)..(354): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaangccaccctctcctgcagggccagtcagagtgttaatagcgacttagcctggtaccagcagatacctggccaggctcccaggctcctcatctatggtgcatctaccagggccactggtactcccagccaggttcagtgcagtggtctgggacngagttcactctcaccatcagcacgcctgctagtctagtaagtattttgcttagtttatacttgtcagctagtaataattaacttcggttacctagtcctacgtaccggtttcggggaccgggggtaaccgtaaaggggtacgggtaacggtaacgttaaccgtaaaaccggtaaccgttagggttacgggtaccgttcggaacccgtaacccgttaacgtttccgttcggtttacccg

SEQ ID NO: 175567 - DNA, 731 bp, Homo sapiens
  misc_feature: GYAE6OF01DTLAD.12.23.C01.1.454.CMB.1.raw
  modified_base (210)..(210): a, c, t, g, unknown or other
  misc_feature (210)..(210): n is a, c, g, or t
  modified_base (711)..(711): a, c, t, g, unknown or other
  misc_feature (711)..(711): n is a, c, g, or t
tcagatacgacgtacacgaccggtgctcgatttagtacacgtgattagggtagttggggggaggaactgctcacgttaggacccagacggaaccatggaagccccagcgcagccttctcttcctcctgctactctggctccagactaccactggagaatagtgatgaagcagtctccagccaccctgtcctgtgtcctccgaggggaacncgcccacccttctccgtggccgaacgggcccaagtccaaggtagttacgttaaatcggccggtaacttaggccctagggtaaccaggtacaagtacgtaccgtgggccgaaggcctacccgaggtcctacccgtacgaaccttcctaagtcgtaacttaaccgtagtttacggaacggtacgggccctaacgttcgggacctaacgttccgttaaccggaaggggtacctaacggtaactttacgaaaggttcgggaccgtaggggttcggggtacgtagggggtaacctacgggttaccttccgaacctttccgtaccctacccctacctacccgtaccgtacccgtaagtaccgtaccgtaggtaacggttacgttttaggtaaacttttacgttacttagttaacctaacgttacgacgtaacgtctaaccgtcggtaccctaccgtacgttcggacggtacggacgtaggtgacgagtacgacgacgaagtgcgacncgtcacgatcgtgtcttacg

SEQ ID NO: 175568 - DNA, 583 bp, Homo sapiens
  misc_feature: GYAE6OF01CG4IG.12.23.C01.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaaggggaaancgcccaccctctcctgccagggccagtcagagtgttaanagcgacttagcctggtaccagcagataccnggcaggctccaggctcctnatctatggtncatcctaccgagggccatggtactcccagccaggttcaggtggcagggtggctgggacagtacgttcactctcaccatccagcagcctgcagtctaggaagttattttggacttaagtttattacgtgtactagtactaagttaattaaacgttaacgttcgggtttacctacggtcttaccgtacggtttccggggacggggggtaaccgtaaagggtaggaacgtacgtaacgaaacggtaacgtggtacggctacggacctaccgattccgtgttcc

SEQ ID NO: 175569 - DNA, 603 bp, Homo sapiens
  misc_feature: GYAE6OF01DX6NX.12.23.C01.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgcccaccctctcctgcagggccagtcagagtgttaatagcgacttagcctggtaccagcagatacctggccaggcctcccgaggctcctnatctagtggtncatcctaccgagggccagtggtactcccgagcctaggttcaggtggctaggtgggtctagggactaggtacgttcacgttctaccgaacctattcgaagtccacgtccgtagctagttctaggtaagttattttgactttagtttacttactgtacagtactaagtattaacttacgtcgttacctgtcttacggtacggtttacgggggacggggtaaccgtagggtacgtaaggtaactacggaaaacggtcgtggtacggcgttacggaccctaccgtagttccgttcgttacc

SEQ ID NO: 175570 - DNA, 553 bp, Homo sapiens
  misc_feature: GYAE6OF01EDJSP.12.23.C01.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (546)..(546): a, c, t, g, unknown or other
  misc_feature (546)..(546): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaatgcgacttagcctggtaccagcagatacctggccaggctcccgaggcctcctcatctagtggtncatctaccgagggccagtggtaactccccgaagccctagggtttccaggtcgggctaggttcggggtctggggaactaggtacgttcacgttctacgaccatcagcagcctgctagtctagtaagtattttgacttagtttattactgtcgagctagtaataatacgttgttcctgtctcgtacggttcgggcggggtaccgagggtgacgacgtacgaaacgtacgtggtagcgtcgacactntcgtgtc

SEQ ID NO: 175571 - DNA, 726 bp, Homo sapiens
  misc_feature: GYAE6OF01BL824.12.23.C01.1.454.CMB.1.raw
  modified_base (204)..(204): a, c, t, g, unknown or other
  misc_feature (204)..(204): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagcccaccctctccctgcgacgggccagtacaggtagttgttaagtacgcgtacttagccgtaggtaccacgcagactaccgtcggccgacggcctacccgacggcctcctactactctagtggtcgctacgtcctaccgacgggacctacgtggtactcccgacgtccgtacggttcgacggtcggcgtagggttcgggtacgtacgggacgtacggtacgttaccgaccttttttccacctaaccgtacgtaccgacgtccgacgtccgtacgtaccgtacgttacgtagtaaacgtttacgttttagtaacgtttagttttaacgtttacgttacgttacgtaacgtacgttaagttaaacttaacgttaacgttacggtttaccgttacgttacgttaccggttaccgggtttccggggtacggggtaaccggtaaggggtacggtaacgtaacgtaaccgtaaacggtacggtacggtacggacgtacgaccgtaaccgtacgttcgttcgttaccg

SEQ ID NO: 175572 - DNA, 604 bp, Homo sapiens
  misc_feature: GYAE6OF01AVT70.12.23.C01.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgccaccctctcctgcagggccagtcagagtgttaatgcgattagcctggtaccagcagatacctggccaggcctcccgaggcctcctcatctagtggtnctatcctaccgagggcctagtggtactcccgagcccgtaggttcaggtcggctaggtcgggtctgggactaggtacgttccacttctacacctatcgagcacgcctgctagtctagtaagttatttgacttagtttattacgtgtctagtactagttaataacttacgttcggttcctagtccttacgttaccggtttccggggaccgggggtaccgtaaggggtacggaacggtacgtaaccgtaaacggtacgttaggtacggtacgtacgaccgtaccgtacgttcgttcgttaccg

SEQ ID NO: 175573 - DNA, 866 bp, Homo sapiens
  misc_feature: GYAE6OF01CVCSV.12.23.C01.1.454.CMB.1.raw
  modified_base (209)..(209): a, c, t, g, unknown or other
  misc_feature (209)..(209): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctccagcccaccctgtctgtcgtctaccgaaggggaaanacgccaccctctcctgcagggccaggtcaagtagtgttaatagctacttagccttggtaaccagcaagactaccgtggccaggcctacccgaggtccctcctctaacttcgtagtgggtcacctattccgtaaaccgacggggtcccctaaggttcggtaccctacccgaacggtcccgtaagggttttccaagggttcgggaccgttaagggggttcgggggtttacccgaggggggtaaaccctaggttaacggttttacccaaccggtttacctacccgaaaccctaacggttaccgaaccggtacccgtaacggtccccgttacggaccgtacggttaccgttaacgggtaaagtttacgtttttaacgggtaccgttttaaggtttttaaactttaaccgtttacgggttacgtaacggtaccgtttaaaggtttaaaacgtttaaaccgttaaccggtttaaccgggttttcccgttacggttacctttacccgggttaaccggggtttaccgggggtaccgggggggtaaaccgtaaggggttacgggaaacggtaaaccggttaaacggtaaaaccggtaaccggttcgggttaacggacccgtttaccgggaaccctaaccgttacgtttccgttcggttttaacccg

SEQ ID NO: 175574 - DNA, 497 bp, Homo sapiens
  misc_feature: GYAE6OF01EPIXR.12.23.C01.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagccaccctntcctgcagggccagtcagatgttaatagcgacttagcctggtaccagcagatacctggccaggctcccaggctcctcatctatggtgcatctaccagggccatggtatcccagccaggttcagtgcagtggctgggacagagttcactctcaccatcagcagcctgcagtctagaatntttgctagtttatactgtcagnagtataatactgttcctgtctctacgttcgggcggggaccagggtgagatacaacgtatggtgacgtcgacacatcgtgttcc

SEQ ID NO: 175575 - DNA, 713 bp, Homo sapiens
  misc_feature: GYAE6OF01BL1OL.12.23.C01.1.454.CMB.1.raw
  modified_base (204)..(204): a, c, t, g, unknown or other
  misc_feature (204)..(204): n is a, c, g, or t
  modified_base (323)..(323): a, c, t, g, unknown or other
  misc_feature (323)..(323): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacctgtctgtgtctccgaaggggaaancgcccaccctctcctgcgagggccagtcaaggagttagttaataggcgtacttagcctaggtaccagcaagactaccgtggccgaggcctcccgaggcctcctacattctagtcgggtncctaatccgtaaccgacgggccctacgttggtaactccccgaagcccgtagggtttccaggtcggactagggtcggggtctaggggactaggtacgtttccaacttcctaccaaccctatccacggacacggtccctggaccctaagggttcctaaggtaaagtttactttttcggacctttaaggtttttaacttacgttcggtaccaagtaccgttaaagtttaacgttaaacttaaccgttcgggtttaccctagtacccgttaccgttaccgggtttccggggggaccggggggtaacctaaaggggttcgggaacgtaacgttaaccgaaaacggttacgtgggtacggtcgtacggacctaaccgtacttccgttcggttaccc

SEQ ID NO: 175576 - DNA, 546 bp, Homo sapiens
  misc_feature: GYAE6OF01DA7CU.12.23.C01.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (400)..(400): a, c, t, g, unknown or other
  misc_feature (400)..(400): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccagggggaaanagccaccctctcctgcagggccagtcagagtgttaangcgacttagcctggtaccagcagatacctggccaggctccaggctcctcatctatggtncatctaccagggccatggtatcccagccaggttcaggtggcaggtgggtctgggacagacgttcactctcaccatcagcagcctgctagtctagtaagtnttttgcttaagtttattactgttcagctaagtaattaataacgttggttactgtcttcgttacggttcgggaccggggggtaccaagggttggaagtacgtaacgaaacggtaacgtggtcggcttcggactacatcgttgttacc

SEQ ID NO: 175577 - DNA, 717 bp, Homo sapiens
  misc_feature: GYAE6OF01BQSN6.12.23.C01.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacctgtctgtgtctcgaggggaancgccacctctcctgcagggccagtcagagtgttaanagcgtacttagcctggtaccagcagataccgtggccaggcctccgaggtcctcctcattctagtggtcnctactcctaccgagggcctagtcggtaactcccgagtccgtaggttcaggtcggacgtagggttcggggtctaggggaactaggtacgtttccaaccgtttctacccaaccgtactaccgaacgccgtaacggacccgttaaggaacggtcccgttaaaggtaacggttaacgtttttacggtacctttaaggtttttacgttaacgtttcgttaccgtacggttacgtaacgggtaccggttaacgaccgtaacggttccgggtacccgtttaccgggtttacgttaaccggttttcgggacccggtaacggggtacccgtaaggtaccggtagggtaacgtaacgtaaccggaaaacggtacgttacggtaccggtacgtaccgacctaaccgtacgttccgttaccgg

SEQ ID NO: 175578 - DNA, 494 bp, Homo sapiens
  misc_feature: GYAE6OF01CVWWZ.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagcccacctctcctgcagggccagtcagagtgttaatagcgacttagcctggaccagcagatactggccagctccaggctcctcatctatgtgcatctacaggccatggtatccagccaggttcagtggcagtggtctgggacagagttcactctcaccatcagcagcctgcagtctagaagtattttgctagtttatactgtcagcagtaataataactgttctgtctctcgttcgggacggggacaagggtgagtatacgaaacgaactgtggctgacacatcgtgtac

SEQ ID NO: 175579 - DNA, 580 bp, Homo sapiens
  misc_feature: GYAE6OF01BO40B.12.23.C01.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctcaggggaaangccaccctctcctgcagggccagtcagagtgttaatagcgacttagcctggtaccagcagatacctggccaggctcccaggctcctnatctatggtncatctaccagggccatggtactcccgagcctaggttcaggtgcaggttggtctgggacaggagttcacttcctacacatcagcagcctgctagtctagaagttattttagacttagtttaatttacttgttacagtctaagttaattaattacgttcggtttaccttgtcttacgtaccggtttccgggacgggggtaaccgtaggggtaggaacggtagtaacgaaacggtaacgttggtacggtaccgtacggacctaaccgtacgttcgttcgttacc

SEQ ID NO: 175580 - DNA, 548 bp, Homo sapiens
  misc_feature: GYAE6OF01BWLOF.12.23.C01.1.454.CMB.1.raw
  modified_base (204)..(204): a, c, t, g, unknown or other
  misc_feature (204)..(204): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgccaccctctcctgcagggccagtcagagtgttaatgcgacttagcctggtaccagcagactacctggccaggcctcccgaggcctcctcatctagtggtgcatcctaccgagggccagtggtactcccagcctaggttcaggtggcgtaggtgggtctgggactaggtacgttcactctcacctatcagcagcctgctagtcgtagtaagtatttgtacttagtttattactgtcagtcagtcgtagcgtacgtcgtccgttcgttcgtacgtttcggccgtacgggtaccgaagtcgtggagacgtacgaaacgtacgtaggtcgtcgtagctacgtgtcg

SEQ ID NO: 175581 - DNA, 513 bp, Homo sapiens
  misc_feature: GYAE6OF01BAF9B.12.23.C01.1.454.CMB.1.raw
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
  modified_base (509)..(509): a, c, t, g, unknown or other
  misc_feature (509)..(509): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcaggggccagtcagagtgttaatagcgacttagcctggtaccagcagatacctggccaggctcccaggcctcctcatctatggtgcatctaccagggccatggtatcccagccaggttcagtggcaggtgggtctgggacagtagttcacttcncacatcagcagcctgcagtctgaagtagtttgctagtttattactgtcagctagtaataatacgttggttcctgcttcgtacgtttcgggcggggtacagggtggagtatacgaaacggactgtggctgacacgctntgtc

SEQ ID NO: 175582 - DNA, 730 bp, Homo sapiens
  misc_feature: GYAE6OF01BY13Y.12.23.C01.1.454.CMB.1.raw
  modified_base (205)..(205): a, c, t, g, unknown or other
  misc_feature (205)..(205): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaancgcccaccctctcctgcagggccagtcagagtgtaatgcgtacttagcctggaccagcagactaccgtggccaggcctccgaggcctcctcactctagtggtcgctataccgtaaccgagggtccctacgttcggtaactccccgaagtcccgtaggtttccaggttcggactaggggttcgggtactaggggaacctaggtacgtttccaccgttctaccgaacctagtacgaacgtcacggtcctaggtaccgtacgttacgttaggtaaacgtttcgttttacgacgtttaagttttaacgtttaacgttcgtacgtaacgttacgtaaaggttaactttaaacgttaaccggttcggtttacccgttacgttaccgttaccggttaccggtttccggggggaaccggggggttaaacctaagggggtacgaacggtaaccgttaacggaaaaccggttacggttcgggttacggtaccgttaccggaccttaacccgttacgttcccgtttcgttaccccg

SEQ ID NO: 175583 - DNA, 523 bp, Homo sapiens
  misc_feature: GYAE6OF01D564P.12.23.C01.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (409)..(409): a, c, t, g, unknown or other
  misc_feature (409)..(409): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagccaccctctccctgcagggccagtcagagtgttaangcgacttagcctggtaccagcagatacctggccaggctcccaggctcctcatctatggtgcatcctaccgagggccagtcggtactcccagcctaggttcagtggcaggtgggtctgggactagacgttcacctcgtacaccatcagcagcctgcagtctagaagtnttttgctatttattactgtcagctagtaataatacgtgttctgtctcgtacgttcgggcggggtacagggtggagtactagaaacgtacgtgtggctcgacacactcgtgttcc

SEQ ID NO: 175584 - DNA, 556 bp, Homo sapiens
  misc_feature: GYAE6OF01CYUCD.12.23.C01.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagagaccaccggagaaattgtgttgacgcagtctccaggcaccctgtctttanctccaggggaaanagccaccctctcctgcagggccagtgagatgttaacaacaggtatctggcctggtaccagcaagaacctggccaggcctcccaggctcctcatgtacgttcttccagcaggccatggcatcccagacagttcacgtggcagtggtctgggacagacttcactctcacctatccacagacgtgacgcctagaagtatttgctagttagtattagttgtctagacgtagtatggtacgtcgcgtaccgttacgtacgttttcgggaccgtacgggtacctaagtcgtggagagtacgaaacgacgtggtggtacgtcgacaccgtactcttacgttacttctcgttccgttcccg

SEQ ID NO: 175585 - DNA, 517 bp, Homo sapiens
  misc_feature: GYAE6OF01DKUNU.12.23.C01.1.454.CMB.1.raw
  modified_base (204)..(204): a, c, t, g, unknown or other
  misc_feature (204)..(204): n is a, c, g, or t
  modified_base (395)..(395): a, c, t, g, unknown or other
  misc_feature (395)..(395): n is a, c, g, or t
tcagatacgacgtacacgaccggtgctcgatttagtacacgtgattagggattgggggaggaactgctcagtttaggacccagacggaaccatggaagccccagcgcagcttctcttcctcctgctactctggctcccagataccactggagaaatgtgatgaagcagtctccagccaccctgtctgtgtctccagggggaaangccaccctctcctgcagggccagtcagagtgttaatgcgattagcctggtaccagcagatacctggccaggctccaggctcctcatctatggtgcatctaccagggccactggtatcccagccaggttcagtggcagtgggtctgggacagagttcacgtctcaccatcagcagcctgcagtctagaagtnttttgctagtttatactgtcagtcagtaataataacttggttacctgtctcgtacgtttcgggacggggtacagggttggagtagtacaaacggtacgtggtggctgacaccattctgttac

SEQ ID NO: 175586 - DNA, 829 bp, Homo sapiens
  misc_feature: GYAE6OF01BBJH1.12.23.C01.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (603)..(603): a, c, t, g, unknown or other
  misc_feature (603)..(603): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacctgtctgtgtctcgaaggggaancgcccaccctctcctgcgagggccagtcagtagtagtaanagcgacttagcctaggtaccagcacgactaccgtggccacggcctaccgacggtcctacctacgtacttcgtagtcggtacgtactacgttaccgaccggacggtaccctagttcggtaccctcccacggtaccgtaggttcgaggtcgggacgttaggggtcgggtacgtacgggaacttacggtcttaccgacctcaacctacgatccgagtcctacgcgttacgacttagttacgtaagttaacgttttaagttgttaaccgttttaacgttttacgtacggttacgtaacggttaacgtaacgtttaaaggtttaaaccttaaaccgggttttcccggttcgggggttttaaccccncggggttttaacccggtacccggggttttaaccggggggggttaaccgggggaaacgggggttaaaccgtttaaacggggggaaccttaaaccggggtttaaacccgtaaacccgggggtttaaaaccggtcgggtttacccggggttaacccggtacccggttaaacccgggtaccttttaaacccccggttcggtttttacgggtacccccttttttaaacccg

SEQ ID NO: 175587 - DNA, 594 bp, Homo sapiens
  misc_feature: GYAE6OF01DW62N.12.23.C01.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgccaccctctcctgcagggccagtcagagtgtaatgcgtacttagcctggtaccagcagactaccgtggccaggcctcccgaggcctcctnatctagtggtcgcctagttcctaaccgagggccctaacgtcggtaactccccgaaggccctagggttccaggtcggactagggtcgggtcgtaggggaactaggtacgtttccacgttcctaccgaacctagtccgacgtccacgtcctgactagtcgtagtaagttattttgacttagtttacttacgttgtctagtctaagttaattaacttacgttcgttcctgtctcgtacggttcgggacggggtacagggtagagtactagaacgtagtcgtagctcgacactcttcgtgtc

SEQ ID NO: 175588 - DNA, 540 bp, Homo sapiens
  misc_feature: GYAE6OF01CEED4.12.23.C01.1.454.CMB.1.raw
  modified_base (204)..(204): a, c, t, g, unknown or other
  misc_feature (204)..(204): n is a, c, g, or t
  modified_base (409)..(409): a, c, t, g, unknown or other
  misc_feature (409)..(409): n is a, c, g, or t
  modified_base (531)..(531): a, c, t, g, unknown or other
  misc_feature (531)..(531): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgttaatgcgacttagcctggtaccagcagatacctggccaggcctcccgaggcctcctcatctagtggtgcatctaccgagggccacgtggtactcccagcctaggttcagtggcaggtgggtctgggacagtagttcactctcacctatcagcacgcctgctagtctagaagtnttttgcttagtttattacgtgtactagtactagtaattaacgttacgttggttcctgtctcgtacgttccggggcgggggtactagggtggagtactacgaacgtacgtgtggctcgcactntcgtgttcc

SEQ ID NO: 175589 - DNA, 656 bp, Homo sapiens
  misc_feature: GYAE6OF01CYPV1.12.23.C01.1.454.CMB.1.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaanagccaaccctctcctgcagggccagtcagagtgttaacagtatacttagcctggtaccagcagacgacctggccaggcctcccgaggcctcctcatctatgatacattaggaagnggaccagtggactatctacgaggtacagtacttcaaagtggacgtaggttcgggacgttaggggactagtaccgtttacacccttcgtacccaccccgtccaccctacgtacctagacgtcctaagtaacgttacgtttttaggtaattttacttacgtagtacctaacgtacggtacgtagaccgtaacgttccggtacccttccgtaaccggtttcgggaccgggtacggaaccgtaagggtacggtaacgtacgtaaaccgaaaccggttaagtacggggttacgtacgttacgaccgtacccgtaagttccgttagttcctttccgtaaccg

SEQ ID NO: 175590 - DNA, 810 bp, Homo sapiens
  misc_feature: GYAE6OF01EGH48.12.23.C01.1.454.CMB.1.raw
  modified_base (171)..(171): a, c, t, g, unknown or other
  misc_feature (171)..(171): n is a, c, g, or t
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
tcagatacgacgtacacgaccggtgctcgatttagtacacgtgattagggattgggggaggaactgctcagttaggacccagacggaaccatggaagccccagcgcagcttctcttcctctgctactctggctcccagactaccactggaagaaatgtgatgaagcagtcnccacgccacccgtgtctgtcgtctacggaagggaaacncgcccaccctctcctgcgagggccagtcaagtagttagttaacnggcgtacttacgccgtaggtaccagcgaagtactaccgtggaccacggtcctcccgaggtcctcccgtactacttccgttaggtcggtacgacctaactacccgtaccggacgggtaccctaacgtcggtaacctccgacgtaccgtacgggttacgaggtcggtacgtagggtcgggtctagggacgtaggtacgttccacgttcaccgtaacctataccgtacggacctacggtccgtacgtaccgttaggttaccgtaaaggttaagttttaccgtttagtaacccgttttaaaggttttaaccgtttcgtacggtaacttaacggtaccttaaaaggtttaacctttaaaaccgggttaccgtttaccggttttaccgtaccggttaacccgttttaaccgggtttaaccgggggttaccggggggaacccgggggttaaaccggttaaacgggggttacgggtaaacgttaaaccggtaaccggttaaaacggttacggtgggtaccgtacgtaccgtaacctaaccggtttcttccgggttactttacccg

SEQ ID NO: 175591 - DNA, 739 bp, Homo sapiens
  misc_feature: GYAE6OF01BFDPB.12.23.C01.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgcccacctctcctgcgagggccagtcagtagtgttaanagcgtacttagcctggtaccagccagactaccgtggccaggcctcccgagtcctcctctatcctatgggtcncagtcctaccgagggcctacgtcggtaactccccgaagtcccgtaggtttaccaggtcggaccgtagggttgggtacgtcggggaactaggtaacgtttccaaccgtttccgacaacccgtaagttccgaacggcacggtccttacggtacgtacgttaccgtaggtaaacgtttacgttttacggtacgtttaagttttaacgtttaccgttagttaccgaggttaccgtaagggttaccgttaaggacccgttaaaccggttcccgggttacccgtttacgggtttacccgttaccggttttaccgggccgggtaaaccggggtaccgtaacgggtcggtaacgggtacgtaacggttaaccggaaaaccggttacggtcggttacgggtacttacggtaccccgtaaacggttccttaccg

SEQ ID NO: 175592 - DNA, 528 bp, Homo sapiens
  misc_feature: GYAE6OF01BUF89.12.23.C01.1.454.CMB.1.raw
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
  modified_base (521)..(521): a, c, t, g, unknown or other
  misc_feature (521)..(521): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccaggcaccctgtctttatctccaggggaaangcccaccctctcctgcagggccagtgagaatgttaacaacaggtatctggcctggtaccagcagaaacctggccaggctcccgggctcctcatgtacgttacttccagcagggccactggcatcccagacaggttcactggcaggtgggtctggggacagacttcactctcaccatcaccagactggagcctagaagtattttgctagtgttattattgtnagcagtatggtagcgctaccgtactacgttttcggccgtacggggtccaggcgtggagagtaggaaacgacgtgtcggtctgcactatctgtcttcncttcccg

SEQ ID NO: 175593 - DNA, 525 bp, Homo sapiens
  misc_feature: GYAE6OF01A7TDV.12.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (518)..(518): a, c, t, g, unknown or other
  misc_feature (518)..(518): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtncatcctaccgagggccacgtggtactcccagccaggttcagtggcaggtgggtctgggacaggagttcactctcaccatcagcagcctgcagtcgtgaagtattttgcttagtttattactgtcagtactagtattaatacgttggttcctgtcttctacgtttcgggcgggggtacaagggtggagactacgaaacgtacgtggtgcgtcgacacntcgtgtc

SEQ ID NO: 175594 - DNA, 712 bp, Homo sapiens
  misc_feature: GYAE6OF01A3GSG.12.23.C01.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (366)..(366): a, c, t, g, unknown or other
  misc_feature (366)..(366): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacctgtctgtgtctccgaggggaaangcccaccctctcctgcagggccaggtcagagtgttaatgcgacttagcctggtaccngcagatccnggccaggcctccgaggctcctcatctagtggtgcatctaccgagggccacgtggtactcccagtccgaggttcaggtggcaggtcgggtctgggacngtcgtttcactctacacctatcagtcgacgtcctggcctagtctacggtaagttacgttttcggaaccgtttaggtttttaacttacggttacgtacgttaacgtaccgtaaggtttaaactttaaacgttacccgtttacgggtttacccttacggtacccgttttaaccccggtttaggggttttacccgggggggaaccccgggggggttaaaccgtaacggggggttaacgggttaaacggttaaacggttaaaccccggaaaacggttaacccgggttagggttaccgggtaccgttacggaaccccggtaaccctacggttttcttcccgggtttaaccc

SEQ ID NO: 175595 - DNA, 763 bp, Homo sapiens
  misc_feature: GYAE6OF01ALZWU.12.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctcgaggggaaancgccaccctctcctgcagggccagtcagagtgttaangcgacttagcctggtaccagcagactaccgtggccaggcctcccgaggtcctccctcacttccgtagtggtcgctacttccgtaccgagggccctacgttgggtacctccccgaggtcccgtagggtttccaggttggaccgtaggggttcgggtcgtaggggaacctaggtacgtttccgaactttccgtaccaacccgtagtccgaacgccgtacggtcccgtaggtaccgtacggttacgttaggtaaacgtttacgtttttacggacgttttaacgttttaacgtttacgttacgttacgtacggtaccgttaaggttaactttaaacgttaaccggtttcgggtttacccttacgttaccgttaccgttacccgggtttaccggggtaccggggtaaccggggttaaccggtaaagggggttacggtaaacggtaacgttaaaccggtaaaaccggttaacggttacgggttacgggtaccgttacgtaacccgtaaccgttacgttccgtttaccgg

SEQ ID NO: 175596 - DNA, 690 bp, Homo sapiens
  misc_feature: GYAE6OF01BLZ09.12.23.C01.1.454.CMB.1.raw
  modified_base (205)..(205): a, c, t, g, unknown or other
  misc_feature (205)..(205): n is a, c, g, or t
  modified_base (457)..(457): a, c, t, g, unknown or other
  misc_feature (457)..(457): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaancgccaccctctcctgcagggccagtcagagtgttaatagcgtacttagcctggtaccagcagataccgtggccaggcctcccgaggcctcctcacgttctagttgggtgcctaatccgtaaccgacggggtccctagtcggtactcccagccgtaggttcaggtcggcgaggttcgggtctaggggactagtacgttccacgttctccaacctatacacgcacgccgtgccgtagttcgtaggtaaagtttnttttaggtacttaagttttacctttaacgtcgttacgtacgtaactaagttaacttaacgttaaccggttcggtttacccttggtaccttaccggttaccgggtttacccggggggacgggggtaacccttaaaggggtacggtaaggtaaccgttaaccggtaaaaccgggtacgttagggtaccggtacggtacggtacccgaaccgttacgttcggttacccgtttaccc

SEQ ID NO: 175597 - DNA, 617 bp, Homo sapiens
  misc_feature: GYAE6OF01C6J8S.12.23.C01.1.454.CMB.1.raw
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctccagataccactgganaaatagtgatgaagcagtctccagccaccctgtctgtgtctccgagggggaaanagccaccctctcctgcagggccagtcagagtgttaatagcgacttagcctggtaccagcagactacctggaccaggcctacccgaggctccctcatctatggtcncatcctaccgagggccctaacgtggtaactccccgaagtcccgtaaggtttccaggttcggcagggttcgggtctaggggacaggtacgttcacgtctcaccatcagcacgtcctgcagttctagtaagttacttttcgacttaagttttacttactagttcagtacctaagttaacttaacttaaccttccgtttccctgtccttaccgttaccggtttaccggggaccgggggtaaccaagggttaggaaggtaactaccggaaacggtacgtaggttcggacgtcgacacctactcgttgttacc

SEQ ID NO: 175598 - DNA, 670 bp, Homo sapiens
  misc_feature: GYAE6OF01A9BI3.12.23.C01.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangcccaccctctcctgcagggccagtcagagtgttaangcgacttagcctggtaccngcagataccgnggcaggctcccgaggcctccncatctatggtncatcctaccgagggccagtggtactcccagcctaggttcaggtcggcagggtgggtacctggggaacctaggtacgtttaccaccgttctaccgaaaccctntccgacgacctacgtcccgtgactacgtcgtacgtaagttatttttcgactttagttttacgttacgttcgtacgtagtacgttaagttaacttaaacgttaacgtcggtttccgtacgttaccgttaccgtaccgggttttaccgggggaccgggggtaaccgtaaggggttacgggaacggtacgtaaccggtaaacggtaaccggtgggttacggtaccgttaccggacccgtaaccgtacgttaccgttccggtttacccg

SEQ ID NO: 175599 - DNA, 788 bp, Homo sapiens
  misc_feature: GYAE6OF01DO60A.12.23.C01.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (453)..(453): a, c, t, g, unknown or other
  misc_feature (453)..(453): n is a, c, g, or t
tcagatacgacgtacacgaccggtgctcgatttagtacacgtgattagggattgggggaggaactgctcagttaggacccagacggaaccatggaagcccagcgcagcttctcttcctcctgctactctggctccagactaccactggagaaatagtgatgaagcagtctccagccacctgtctgtcgtctacgaggggaaancgccacctctcngcgaggcagcagtagtagtaatacgcgtacttacgccgtaggaccagcaagactaccgtggccgacggcctacccggagtcctcctactattcgtagtcggtcactacgttcccgaacggcgggtaccctaacggttcggtaccacccgacggtaccgtagggtttacaagggtcggacgtaggggttcggtacgtacgggaactagtacgtttaccacttacaccgactacgtacgngaccgtacggtctggtacctacggttataacggtaaagttttccgtttacgggtaccttttaaggtttttaacctaccgttggtaaacgtaacgttaacgttaaacgttttaacgttaaaacgtttcccgggtttacgggttccccttacgggttcccgtttaacgggttaaccccggggggttccgggggggggaaaccgggggttaaacccgtaaggggttacggggaaacgttaaaccgttaaaacccggaaaaccgggttttgggttcccggggtaacgtcccgggtaacccctaaaccttaccggtttgttaccgggttttcccttaacc

SEQ ID NO: 175600 - DNA, 749 bp, Homo sapiens
  misc_feature: GYAE6OF01CXIAG.12.23.C01.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctccagcccaccctgtctgtgtctccgaggggaaanacgcccaccctctcctgcgagggccagtcagagtgtaangcgtattagcctggtaccagcagactaccgtggccaggcctcccgaggcctcctacactctagtggtgctatccgtaaccgagggccaacgtggtacctccccgagtccgtagggttccagggtcggacgtagggttcgggtccgtaggggaacctaggttacgtttcccgaacgttcctaccaacccgtattccaacggtccaggtaccctggaccgtaacggttacgttaagggtaaaacgtttcgttttttacggaccgttttaaagttttttaacgttaactttcggttaactacggttaacgttaaagtttaaacgtttaaacgttaaaccgtttcgggtttaccttacggtaccctttacgggttaccgggtttaccggggggaccggggggtaaaccggtaaggggttacggggaaacgtaacgttaaaccggaaaacggttacggttacgggtacggtaccgtacggtaaccctactacgttcgttccggttaccc

SEQ ID NO: 175601 - DNA, 886 bp, Homo sapiens
  misc_feature: GYAE6OF01CS8TF.12.23.C01.1.454.CMB.1.raw
  modified_base (208)..(208): a, c, t, g, unknown or other
  misc_feature (208)..(208): n is a, c, g, or t
  modified_base (324)..(324): a, c, t, g, unknown or other
  misc_feature (324)..(324): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctaccgaagggggaaacncgcccaccctctccgtgcgacggggccagtcaagtagtagttaatagcgaacgttagccgttaggaccagccaaggtactaaccgtgggaccagggcctcccgacgggcctccctnaacttcttaagtgggtcacctaacttccgtaaccggacggggaccctaacgttcgggttacctacccccgaaggtccccgtaaggggtttccaacgggttcgggacgtaggggttcgggggtaccttaggggggaaacctagggtaaccggttttacaacccggtttacgtaccaaaccccggtattaccgaacgaccgaacggtaccccgtaggtaccgtaacggtaccgttaaggtaaacgggtttaatttttacggtaccgtttaaacgggttttttaacttaaccgggtttacttaacccgttaagggtaaaccgtttaaagggtttaaacttaaaaccggtttaaaccgtttaccgggggtttaccccttaggttaccctttacccgggttaacggggttttacccggggggaaccgggggggtaaacccgtaaagggggttaccgggtaaacgggtaaaccggttaaccggtaaaaaccgggttacggttacgggttaaccgggtaccgttaaccggaccgttaaacccgtacgttcccggttaacggttttaccc

SEQ ID NO: 175602 - DNA, 604 bp, Homo sapiens
  misc_feature: GYAE6OF01C4F4R.12.23.C01.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccatggagaaatagtgatgaagcagtctccagccaccctgtctgtgtctccgaggggaaangcccaccctctcctgcaggggccagtcagagtgtaatgcgtacttagcctggtaaccagcaagatacctggccaggcctcccaggctcncatctatggncatccacgngggccacgtggactcccgagccgaggttcaggtcgacgtaggtcggtctagggaacaggtacgttccacttcgtacaaccgattccgagtccacgtacctgacctagtcgtaggtaaagtcgttttcgtacttagttttattacgttgtactagtactagttaactaacttaacgttcggttcctagtccttacgttacggttcggggaccgggggtaacgtaagggtggaacgtacgtaacgaaaacggtacgtcggtacggactacgacctacctacttccgttgttaccg

SEQ ID NO: 175603 - DNA, 558 bp, Homo sapiens
  misc_feature: GYAE6OF01A4I4T.12.23.C01.1.454.CMB.1.raw
  modified_base (204)..(204): a, c, t, g, unknown or other
  misc_feature (204)..(204): n is a, c, g, or t
  modified_base (422)..(422): a, c, t, g, unknown or other
  misc_feature (422)..(422): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgcccaccctctcctgcagggccagtcagagtgttaatgcgtacttagcctggtaccagcagatacctggccagacctcccaggcctcctcatctatggtgcatcctaccgagggccctacgtggtactcccagccgaggttcaggtggcgtaggtgggtcgtgggacaggtagttccactctccaccatcgagccagcctgctagtctagtaagttntttgacgtttagtttactacgtgtacagctaagttaataactacgtgttcctgtctcgtacgttcggggacggggtaccaggtggagtacgtacgaaacggtgtgtcggtactcgactacctcgttcgtcgttacc

SEQ ID NO: 175604 - DNA, 721 bp, Homo sapiens
  misc_feature: GYAE6OF01DPQ2J.12.23.C01.1.454.CMB.1.raw
  modified_base (205)..(205): a, c, t, g, unknown or other
  misc_feature (205)..(205): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaaggggaaanacgcccaccctctacctggcgagggccagtcaagtagttagttaatagcgtacttagcctaggtaccagacagactaccgtggccaggcctcccgaggtcctccgtcaattcctagtcggtgcacttccgtaccgagggcccaacgttcggtacctcccgagacccgtaggtccgaaggtcggcgtaggttcgggtcgacgggactaggtacgttcactctacaccatcacgacacgtccgtgctagtctaggtaagtttagtttacgacgtttaagttttacgtttacgttacgtacgtaaggtaccttaaaggttaacgtttaaacgttaaccgtttccgggtttaccttacggttaccttaccggtttaacgggtttacccgggggaccgggggtaaccgtaaagggggtacggtaaacggttaaaccgtaaacggaaaaccggttacggttaacggtacgggttaccgtacgggtaaccgtaacccttacgtttcgttacgttttaaccccg

SEQ ID NO: 175605 - DNA, 641 bp, Homo sapiens
  misc_feature: GYAE6OF01AZLCO.12.23.C01.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatgtgatgaagcagtctcagccaccctgtctgtgtctccgaagggggaaacngcccaccctctcctgcgagggccagtcagagtgttaangcattagcctggaccagcagataccctggccaggcctcccgaggtcctcctnatcgtagtcgggtncctagtccctacggacgggcctagttgggtacctccccgaaggtcctaagggtttccaaggttcgggacgtagggttcggggtacgtacggggaactaaggtacgttccacttctaccgaacctagtcacgtacacgtccgtagtaccgtacgtacgtagtaagttacttttacgtactttagttttacttacgtgttacgagtactaagttaataacgttacgttacgttctgtaccttaccggtacggtttcggggaccggggtacgtagggtacggacgtacgtacgaacgtagtcggtagacgtacgacctacgtcttgtcggttacc

SEQ ID NO: 175606 - DNA, 672 bp, Homo sapiens
  misc_feature: GYAE6OF01EZIRO.12.23.C01.1.454.CMB.1.raw
  modified_base (205)..(205): a, c, t, g, unknown or other
  misc_feature (205)..(205): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaangccaccctctcctgcagggccagtcagtagtgttaatagcgtacgttagcctaggtaccagcagactacctggcccaggcctcccgaggtcctcctacattctagtggtncatccgtaccgngggccacgtggtactccccgagtcccgtaaggttcgaggtcgggctaggggttcgggtcgtggggaactaggtacgttaccacttccgtaccaacctataccgaagccaacgccgtcggctacggttacctaggtaaacgtttagttttcgacgtttaagttttacgttaccgttagtacgtacggtattaacgttaacttaagttaaccgtttgggttacccttgtaccgttaccgttacgggtttccgggggacgggggtaaccgtaacggggtaggtaacgtaaccgtaacgaaacggtaccgttggtaccggtaccgtcgtacccacgtcttcgtcgttcc

SEQ ID NO: 175607 - DNA, 613 bp, Homo sapiens
  misc_feature: GYAE6OF01C8PUV.12.23.C01.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
  modified_base (448)..(448): a, c, t, g, unknown or other
  misc_feature (448)..(448): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccagggggaaanacgcccaccctctcctgcagggccagtcagagtgttaanagcgattagcctggtaccagcaagactaccgtggccaggcctcccgaggcctcctcatctatggtncatcctaccgacgggccagtggtactcccgagtcctaaggttcaggtggcgtaggtcgggtctgggacaggtacgttcactcgtcaccatcagcagtcctgcagtcgtagtaagttctttgcttagttttactacgttntacgtagtcctaagttaattaacttaacgttcggtttccctaggtccttacgttaccggtttccgggggtaccgggggtaacgtacggggtaggaacggtaacgtaaccgtaaaccggtacgttagggtacgtacgtacgaccctaccgtactcgttcggttacc

SEQ ID NO: 175608 - DNA, 543 bp, Homo sapiens
  misc_feature: GYAE6OF01CBMS0.12.23.C01.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagccaccctctcctgcagggccagtcagagtgttaatagcgtacttagcctggtaccagcagatacctggccaggctccaggctctcatctatggtncatctaccgagggcctacgtggtactcccgagcccgtaggttcagtggctagggtcgggtctagggacaggtagttcactctacacatcagcacgcctagcagtctagtaatgttttgacttagtttatactgtacagactagtataatacgtgttctgtctcgtcgttcgggacggggtacctaggtggagtacgtacgaaacgtcgtggtggactacggacctactagttccgtgttacc

SEQ ID NO: 175609 - DNA, 608 bp, Homo sapiens
  misc_feature: GYAE6OF01DVWKU.12.23.C01.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
tcagatacgacgtacacgaccggtgctcgatttagtacacgtgattagggattgggggaggaactgctcagttacggacccagacggaaccatggaagccccagcgcagcttctcttcctctgctactctggctccagataccactggagaaatgtgatgaagcagtctccagccacctgtctgtgtcacgagggaancgccacctntctgcagggccagtcagagtagttaatcgcgtacttaggccttaggtaccagctagacgtacctcggaccacggcctaccaggtcctccgtcattctagtggtgactattccgaccagggcctaagtcggtaactacccgaagtccaaggtttccaggttcggcgtaggtcgggtacgtgggtactaggtacttccacttccgtacacctattccgaagtcacgtccgtagccgtagtctagtaagttacgttttgatttaagtttacttacgtgtaccgagtacttaagttaacttaagttacgtcgttcctagtctcgtacggtttcgggacgggtactagggtgaagtacgtaacgaacggtcgtggtcgacgtacgacctacgtactcgtgttaccc

SEQ ID NO: 175610 - DNA, 604 bp, Homo sapiens
  misc_feature: GYAE6OF01EFKVN.12.23.C01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccaccggagaaattgtgttgacgcagtctccaggcaccctgtctttgtctccgggggaaangtcaccttctcctgcagggccagtcagagtcttagcacctacttagcctggtaccaanagaaacctggccaggctcccaggcctcctcatctatgatgcataccgaaaagggccaacgtggacactcccagccaggttcagtggcaggtcggggtcgtgggggcaggtaccttcgacttctaccacctatcagccagtcctagacgcctagaagtattttagacttagtttattacgtgtcagtcagtcgtacgactaacgtcgtccgttcggttctacgtttcgggaccgtacggggaccaaggtcgtagggaacgtacgtaccgtaaaacggtacgtcggtacggacgtcggacccacgtacgttcttacgttacctttctaccgttcccgttaccccg

SEQ ID NO: 175611 - DNA, 779 bp, Homo sapiens
  misc_feature: GYAE6OF01B3OLP.12.23.C01.1.454.CMB.1.raw
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
  modified_base (493)..(493): a, c, t, g, unknown or other
  misc_feature (493)..(493): n is a, c, g, or t
tcagatacgacgtacacgaccggtgctcgatttagtacacgtgattagggattgggggagaactgctacagttaggacccagacggaaccatggaagccccagcgcagcttctcttcctctgctactctggctcccagataccactggagaaatagtgatgaagcagtcctcagccacctgtctgttgtctaccgggggaaagcgccaccctntaccgtgcacgggccagtcagtagtgttaatacgcgacttagcctggtaccagcaagacttacccgtggacccaggtcctacccgaggtccttaccgtnaacttccgtaagttgggtacgacgtacgtttaccgtaaccggacggggtaccctacggttggttaaacccttcccccgaaggtaccccgttaagggtttcccaaggggttcggaaccgttagggttcggggttacctagggggaacctaggtacgtttcccaccgttccgtacaacccgtntaccgaacgccaacgtacccgtcggtaccgtagttaccgtaaggtaacgtttacgttttacgacgtttaaggttttacgttaccgttaggtacctagtacgtaacgtttaattaaaccgttaacggttcggtttacgttacggtacccgtttacggttaccgggttttacggggaacccgggggttaacgtaaggggttcggtaacgttacggtaaccgtaacggtaacggttcggttacggtacgttacggtaccttaaccgttacgttcttcgttcttacccgg

SEQ ID NO: 175612 - DNA, 815 bp, Homo sapiens
  misc_feature: GYAE6OF01B73GV.12.23.C01.1.454.CMB.1.raw
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagactaccactggaagaaatgtgatgagcagtctcagcccacctgtctgtcgtctacggaaggggaaacncgcccacccttctccgtgacgacgggccagtcgagagttagtaatgcgtacttacgcctaggaccagcagtactaccgnggaccncggcctacccgaggtccctccctagtacttcgtagtcggtcnctaacgttccgaccggagggccctaacggttacggcctaccccgaacggtccgttaacgggttccggaaggttcggggtattacgggggttcgggttccgacggggaaactacggggttactttaccgtaccgtttacccgccgaaacccgtagttccgacggttaccgaaccggtttccgtacgggtctaaccgggtttccttaagggttaaacgtttcgtttttacgggaccttttaaaggtttttacttaacccgggttggttaacccgtaagggtttaccttaaaagggttttaaccgttaaaaccggtttccggttttaacgggtttccccttacggttaaccccgttttacggggtttacccggggttaaccgggggggccggggtaaaccttagggggtcggtaaacgtaccgtaaaccggtaaacgttgtccgggtacggtactcggacctaactacgttcgtaccctttccg

SEQ ID NO: 175613 - DNA, 655 bp, Homo sapiens
  misc_feature: GYAE6OF01C0WCP.12.23.C01.1.454.CMB.1.raw
  modified_base (205)..(205): a, c, t, g, unknown or other
  misc_feature (205)..(205): n is a, c, g, or t
  modified_base (334)..(334): a, c, t, g, unknown or other
  misc_feature (334)..(334): n is a, c, g, or t
  modified_base (584)..(584): a, c, t, g, unknown or other
  misc_feature (584)..(584): n is a, c, g, or t
tcagatacgacgtacacgaccggtgctcgatttagtacacgtgattagggattgggggaggaactgctcagttaggacccagagggaaccatggaagccccagctcagcttctcttcctcctgctactctggctcccagataccaccggagaaattgtgttgactcagtctcacgcccacctgtctttgtctccgaaggggaaangccaaccctctcctgcacgggccagtcagagtagttaacagtatacttagcctaggtaccagcagacgacctggccaggcctccgaggcctcctcactctatgaatacattgaagcggcacgtgcatcncgagcagacttacagtgcgtaggtcgggtactagggacacggtccttacgacctccttacccgaccctacgacctaccgaccgtacgacgtacccgtaggtaacgtttacgttttagggtaaacttttacgttacttacgtaactaacgtacgtacgtacgtactaccgtccgtccccttaccgtaccggtttcggaccgggaacggtaccgtaaggtacggagaacgtaccgaacggacggttaaccgnggttacggccgtcggccctaacgttacgttccgttacggttaccttaccgtaccgttccccgttaccccgg

SEQ ID NO: 175614 - DNA, 732 bp, Homo sapiens
  misc_feature: GYAE6OF01D1BSS.12.23.C01.1.454.CMB.1.raw
  modified_base (206)..(206): a, c, t, g, unknown or other
  misc_feature (206)..(206): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatgtgatgaagcagtctccagcccaccctgtctgtcgtctccgaaggggaaanacgcccaccctctccgtgcgacggccagtcagtagttgttaaatgccgtacgttacgccttaggtaaccagcgaacgacttaccgtcggacccgtaggccctacccgaggcccttcccgtactacttcgtagttcgggtcgtacctactaccgtaccggacgggtacctacgttcgggtacctcccgtacggccgtacggttcgaggtcggacgtagggttcgggtcgtagggactaggtcgttccactcgttacacctatccgagtaccgacgtcctacggacgtacgttacgtaggtagtttacgttttacgtacgtttaagttttacttaccgttgtactagtacttaagtaactttaacgttaccgttcggtttaccgtcgttaccgttacggttccggggttaccgggggacggggtaaccggtaagggttacgggtaacgtaaacgttaacggtaaaccggtacgttacggggtacgttacccgtacgtaaccctacgttacgttccgttacgttacccg

SEQ ID NO: 175615 - DNA, 585 bp, Homo sapiens
  misc_feature: GYAE6OF01ALEVV.12.23.C01.1.454.CMB.1.raw
  modified_base (204)..(204): a, c, t, g, unknown or other
  misc_feature (204)..(204): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaancgccaccctctcctgcagggccagtcagagtgttaatagcgacttagcctggtaccagcagactaccgtggccaggcctcccgaggcctcctcatctagtggtgcatcctaccgagggccacgtggtactcccgagccctaggttccaggtggctaggtcgggtactggggaactaggtacgtttccaacgttcctaccacctagtccacgcacgcctggctagttctagaagttacttttgactttaagtttactctgtcagctaagttaactaagttacgttcggttactgtcttcgttacggttcggggacggggtaccaagggtggaagtctaacgaaacggtacgtggtcggtcctagaccacacttcgttgtacc

SEQ ID NO: 175616 - DNA, 577 bp, Homo sapiens
  misc_feature: GYAE6OF01DD67Y.12.23.C01.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (568)..(568): a, c, t, g, unknown or other
  misc_feature (568)..(568): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactgganaatagtgatgaagcagtctccagccacctgtctgtgtctccgaggggaaangccacctntcctgcacgggccagtcagagtgttaatagcgtacttaggcctggtaccagcagactacctggccaggcctcccgaggcctcctcatctagtgggtnctatcctaccgngggcctacgtggtaactcccgaagtcctagggttccaggttggactaggttcgggtactgggactaggtacgtttccaacgtctcacctatcacgcacgcctgctacgtcgtagtaacgtactttcgacttagtttactacgttgtcgagcgtagtcgtacgctacgtcgcctccgtacgttcggacggtacggtacgtaggtacgacgtacgtacgaacggcgtaacgtggtacgtcgtacgacacgngttcgtacg

SEQ ID NO: 175617 - DNA, 679 bp, Homo sapiens
  misc_feature: GYAE6OF01AN4SU.12.23.C01.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatgtgatgaagcagtctccagccacctgtctgtgtctccaggggaaangccacctntcctgcaggccagtcagagtgtaangcgacttagccttggtaccagcagactacctggccaggcctcccgaggccttacctcactctagtcggtncagtccaaccgacgggtccacgttggtaactccccaagtcccgaggtttccaggttcggcctagggtcgggtacctaggggaccaaggtacgtttccaacgtttccgtactaacccaagttcccacggacctaacggccctaggaccaaggttccgtaggtaacgttacgttttcgacttaacgttttatttaccgtggtaccgaacgtaccgtaacgttaacttaaacgtttaaccgttcgggtttaaccctcgttaccttaccgtaaccgttttccgggggaccgggggtaaccgtaaagggttcggaacgtacgtacgtaaaaccggtgttacggtacggtacgtacgtacccaacgtcttcggtgttaccg

SEQ ID NO: 175618 - DNA, 791 bp, Homo sapiens
  misc_feature: GYAE6OF01DELBA.12.23.C01.1.454.CMB.1.raw
  modified_base (220)..(220): a, c, t, g, unknown or other
  misc_feature (220)..(220): n is a, c, g, or t
  modified_base (765)..(765): a, c, t, g, unknown or other
  misc_feature (765)..(765): n is a, c, g, or t
  modified_base (774)..(774): a, c, t, g, unknown or other
  misc_feature (774)..(774): n is a, c, g, or t
  modified_base (780)..(780): a, c, t, g, unknown or other
  misc_feature (780)..(780): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggcctcccagactaccactggaagaaatgtgatagaagcagtcctccacgcccacccgttgtctgtcgtccgtaccggaagggggaaacncgacccctacccttccgttccgtggaccgacgggggtccctaaggtaccaaggttagttacggtttaaagacggtaccggttaactttaccgggacccgttacgggtaacccaaggtaccaacggttaaccgttacccgtcgggtaccccgaacgggtcccccttacccggaacggtcccttaccccgttacctaacgtttccgttaacggttcgggtaaccaccgttaacgtttacccggtaaaccgggccgggtaaccctacggttacggtacctccccggaagtcccgttagggttccgaggttcggacgttggggtcggtcgtacgggactaggttacgttcctacctctactacgtactcgacgtcgacgtccgtgtaccgtagtttacgaaggttacgtttagtttacgtactttaacgttttacgttacgtggactagtcgacggtacgtacgtacgtaccgtcgttaccgttcgtttaccgttacggtcggtaccgacgggtaccagggtccgtaagacacgtaacggaacgttacncgggttacncgtacncttccgtgtcc

SEQ ID NO: 175619 - DNA, 599 bp, Homo sapiens
  misc_feature: GYAE6OF01DP1TC.12.23.C01.1.454.CMB.1.raw
  modified_base (150)..(150): a, c, t, g, unknown or other
  misc_feature (150)..(150): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (389)..(389): a, c, t, g, unknown or other
  misc_feature (389)..(389): n is a, c, g, or t
  modified_base (595)..(595): a, c, t, g, unknown or other
  misc_feature (595)..(595): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctccagataccatggaanaaatgtgatgaagcagtctccagccaccctgtctgtgtccaccgaagggggaaacacgccctacccctcgtcctggacacggggcctaggtcagagttgttaaacngactacttagcctggaccagntaagctaccgtggccaggtccnccaggctccncagtctagtggcacactcgaccagggccactggactccaccgagccgtagtcgagtgagtggtggcgacgataggactcnctacacgaactcagcacgattcgacgtactgtacgtaagtacgtttagttacgtagtttaagtttacctaggtctaaccgtagtactaaattaacgttaagttaccgttcgtacctcgttacgtccggttaacgggtcgggggacgtaagggtagcggtaaacaacgtacgaaaggtactgggtacgtcaacgtcctaagtcgttntacc

SEQ ID NO: 175620 - DNA, 795 bp, Homo sapiens
  misc_feature: GYAE6OF01BHKGQ.12.23.C01.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgagggaaancgccacctntcctgcagggccagtcaagagtgttaangcgtacttagcctggtaccngcagtactaccgtggccaggccctacccgtagggcccttcccctagtaacgttccgtaagttcgggttcacctaacttccgtaacccggacgggacccctaagttcgggtaaacctcccccgtaaggaccccgtagggtttaccaacggtcgggaccgtaagggttcggggttacgtagggggaacctagggtacgttttccaaccgttcctaaccaccctaagtccgacggtaccacgggtaccttcgggaccttacgtaccgttagggaaacgtttacgttttacggtaccgtttaagttttaacgtttaccgtaggttacctaacggtacctaaagttttaacgtaaaacttacgtttacgggttacccttggttaccgttaccgttaccgggttttaccgggggaacccgggggtacctaaacggggttacggtaacggtacgttaacccgggaaaacggtttaccggtacggttaggacccgtttacgggacccaaacccggttcgtttaccggtacggttttaccccg

SEQ ID NO: 175621 - DNA, 604 bp, Homo sapiens
  misc_feature: GYAE6OF01CDD65.12.23.C01.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccactggagaaatagtgatgaagcagtctcagccaccctgtctgtgtctccgaggggaaancgccaccctctcctgcgagggccagtcagagttgttaaancgcgtacttacggcctggtaaccagcaagtaactaccgtcggccaaggcctacccaggccttccgtcatccgtatcggtagcctaagttcctaaccgaggggccctaacgttcgggtacctcccaagccgtaggttcaggtggcgagggttcggtacgtagggactaggtacgtcacctctaccactacgtcagctacgcctacgctacgtctaagtaacgttatttcgtacttagtttacttactcgtacagtacaagttaataattacgtcgttctacgtctacgtacggttcgggacggggtacaggtagaacgtcgtaacgaagtacgtggtcggctacgcactctcgtcgttacc

SEQ ID NO: 175622 - DNA, 825 bp, Homo sapiens
  misc_feature: GYAE6OF01CRCH6.12.23.C01.1.454.CMB.1.raw
  modified_base (207)..(207): a, c, t, g, unknown or other
  misc_feature (207)..(207): n is a, c, g, or t
  modified_base (310)..(310): a, c, t, g, unknown or other
  misc_feature (310)..(310): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtcctccagcccaccctgtctgtgtctccgaaggggaaanacgcccaccctctcctgcgagggccagtcagtagtagttaagagcgtacttagccgtggtaaccagcaagactaccgtggaccaggcctcccgaggcctcctnattcgtagtggtcgcctagtcctaccggacgggccctagttcggtactccccgaagtccgtagggtttcaaggttcggacgtacgggttcgggggttacgtacgggggtaaactacgggtaacgttcccgtaaccgtttccccgtaaccaaacccctaagtttacccggaacggtaacccgacccgggttaccccttacgggtacccgttaacgggtttacggtttaaacggtttaaaaagggtttcgtttttttacggtaaccggtttttaaaggtttttttaacgttacccgttttaggttaaccgtaaggttaaccgttaaagtttaaacctttaaacgtttaacgtttccgggttttacctacgttacccgtttaccggttaccgggtttaccggggggacccgggggtaaaccgtaaaggggtcgggtaaacgtaacgtaaacggtaaacggtaacggtttcggtacggtaccgtacggaacctaccgttaacgtttcgtcggtttaccc

SEQ ID NO: 175623 - DNA, 718 bp, Homo sapiens
  misc_feature: GYAE6OF01C8B8S.12.23.C01.1.454.CMB.1.raw
  modified_base (445)..(445): a, c, t, g, unknown or other
  misc_feature (445)..(445): n is a, c, g, or t
  modified_base (525)..(525): a, c, t, g, unknown or other
  misc_feature (525)..(525): n is a, c, g, or t
  modified_base (563)..(563): a, c, t, g, unknown or other
  misc_feature (563)..(563): n is a, c, g, or t
tcagatacgacgtacacgaccggtgctcgatttagtacacgtgattagggattgggggaggaactgctcagttaggacccagacggaaccatggaagccccagcgcagcttctcttcctctgctactctggctcccagactaccactggagaaatagtgatgaagcagtctccagcccaccctgtctgtcgtcctacgaaggggaaactcgccctaccctctcccgtggaccgaggggccaaggtcaaggtagttagttaaatcggacgtacgttaacgccttagggtaacccaggactaaggtaccttaacccgtggacccgaacgggtccttaacccggaggccttccctactaacgttctagttcggtcgactacttccaaccggacgggacctacgttcggaccttcccaggtacccgaggtttccgaaggttcggaacgngggtcgggttacgacgggtaactacggtacgtttccacgtactccgaacactcgaacgtcacgtcccgtgactacgtttnaagtaaggtttaatttcgtacgttaagttttacttagngtacgaagtacaaggttattaacgtacgtttgtccctaggtcctacgttacgggtccggggtacgggtaactagggtacggaacgtaacgtaaaccgaaacgtccggtggtacgggtacctaccggaaccctaggtacctttgtcgtttaacccg

SEQ ID NO: 175624 - DNA, 648 bp, Homo sapiens
  misc_feature: GYAE6OF01B0CGJ.12.23.C01.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (632)..(632): a, c, t, g, unknown or other
  misc_feature (632)..(632): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatgtgatgaagcagtctccagccaccctgtctgtgtctccgaggggaaanagcccaccctctcctgcagggccagtcagagtgttaangcgacttagcctggtaccagcagatcctggccaggctcccaggctcctcatctagtggtgctatccgtaaccgacggggcccacgttgggtaactccccgagtccgtagggttcaggttgggcagggttcgggttctacggggacctaaggtcgttccacgttcgtaccaccgatcacgctacgcctgactacggttcgtagtaagttcttttacgctttaaggttttacttacgtgttactagtccgttaagtaattaaacgttaacgttcggttcgtcgttcttaccgttccgggtttacgggggaccggggggtaacgttaacggggtaggtacgtaacgtaaccggaaaacggtacgttacggttcggaccgtacggaccctaaccncgttcgtcggttaccc

SEQ ID NO: 175625 - DNA, 787 bp, Homo sapiens
  misc_feature: GYAE6OF01CRKO9.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggcctcccagactaccactggaagaaatagtgatgaagcagtctccagcccaccctgtctgtgtctccgaaggggaaacacgcccaccctctccgtgcagggccagtcgaaggtagttagttaatagacgtacgttacgccgttagggtaaccaggaccaaggtacgttaccgtacgggccgaacgggtccctaccccggagggtcccttcccctactaacttccgtaagttcgggtcgacctaacgttacccgtaaccggaccgggtaccctaacgttcggtaacctaccccgacgtacccgtaaggttccgaggtcggacgtaggggtcgggttacggtagggaacgtaggtacgtttaccgacttccactaacctataccgacgaccgacggtccgtaggtactacggttcgtaaggtaacgtttagttttacgtacgtttaagtttaacgtttacgtacgtaacgttaacgtttaacggttttaaactttaccgtttaacccgtttacggttttaaccggtttcccgggtacccgttacgggtaaccctacgttaagtacgtaacgttaactaaccgtaaaacggtccgttaggtaccggtctacgaccgtaaccgttactttccttacgtttccttacgttaccgttccccg

SEQ ID NO: 175626 - DNA, 960 bp, Homo sapiens
  misc_feature: GYAE6OF01DGVA7.12.23.C01.1.454.CMB.1.raw
  modified_base (207)..(207): a, c, t, g, unknown or other
  misc_feature (207)..(207): n is a, c, g, or t
tcagatacgacgtacacgaccggtgctcgatttagtacacgtgattagggattgggggaggaactgctcagttaggacccagacggaaccatggaagccccagcgcagcttctcttcctctgctactctggctcccagataccactggaagaaatgtgatagaagcagtctccagcccaccctgtctgtgtcctacgaaggggaaancgccacctctctgcagggccaggtcgagtagttagttaatacggcgtaacgtttaggccttacggtaaccaggacgtaacgaacttacccgtgggacctacggcctcccgaggtcccttcctctactccgttagtcgggtacacctaacgttacccgtaccggaccgggtaccctaccggtttacggtaacccgtccccgtaaacgggtacccgttaacgggtttaccgaacgggtcgggtacggttacgggggttcggggtttaccggtaggggaaccgttacggttaacgtttacccacgttaccgttaaccaaccgttacgtacggaccgtaccaacgggccccttagggaccttaacgggtttacgtaaaggtttaacggtttacgttttacgggtaacgttttaacgttttaaccgtttccggtaacgggtttctaaacggttaaccgggtttaaaagttttaaacgtttaaaaccgggttttacccgggtttccgggttttaacccgttaacccgggttttaccgttaacccggggtttttaaaccgggggggttttcccccggggggggaaaaggggggttaaaccccggtaagggggttaacggggtaaaaacccgggtaaaccggttaaaaaccccggggaaaacgggttccgggttttaacggggggtcccgtttaaaaccccggtcggtttaaaaccccggttaccggtttccggttttcccggtaacggttttttaccccg

SEQ ID NO: 175627 - DNA, 787 bp, Homo sapiens
  misc_feature: GYAE6OF01DRZYO.12.23.C01.1.454.CMB.1.raw
  modified_base (254)..(254): a, c, t, g, unknown or other
  misc_feature (254)..(254): n is a, c, g, or t
  modified_base (455)..(455): a, c, t, g, unknown or other
  misc_feature (455)..(455): n is a, c, g, or t
  modified_base (760)..(760): a, c, t, g, unknown or other
  misc_feature (760)..(760): n is a, c, g, or t
tcagatacgacgtacacgaccggtgctcgatttagtacacgtgattagggattgggggaggaactgctcagttaggacccagacggaaccatggaacgccccagcgcagtcttctcttcctcctgcctactcgtcggcctcccagactaccacgtgggaataaatgttgataggaacgtctagtcctaccacgccctacccgttgtcctggtcgtacctacggaaggggaaactccgccctacccgttctcccnggacgacgggcctagtcgaggtacgttaagtttaagcggtaccgtaacgtttacgccgttaggtaaccaggcctaagtacccgttaccgcggacccgtagggccctacccggagtccctactacgttacttcgtaggttcgcgtactaccgtacggaccggacgtactacgtcgtacccgcgaccgttcgtaggtcgtcgnggtacgcgggttcggcggaaaggtactcgttactccgttacccacgtactaaccactacggacgtaccgacgtcgcgtacgtccttaaggtacgtttacgttacctagttacgtttaccttagttacggtacgtcgtaacgttacgttaacggttaaaacttcgtttacccggttccgttaccgttacggttcccgttaacggggtaccgggggttaaccgggaacggtaaacggggtaccggtacgtaaaacggttacgaaaaccggttcgtacggggttaccgagttaccggacccggttaanaaccgtttcgttcccggttacttaccc

SEQ ID NO: 175628 - DNA, 834 bp, Homo sapiens
  misc_feature: GYAE6OF01EBPQ5.12.23.C01.1.454.CMB.1.raw
  modified_base (240)..(240): a, c, t, g, unknown or other
  misc_feature (240)..(240): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctccagataccactggagaaatagtgatgaagcagtctccagccacctgtctgtgtctacgaggggaaagcgccacctctctgcgagggccagtcagtagtgttaaanagcgtacttagccgtaggtaccagcaagactaccgtggaccaggtcctccgaggccttcctactattctaagtgggttcgacctaacgtccgtaaccgacgggaccctaacgttggtaactaccccgagtacccgtaggttacgaacggttcggacgtaggggttcgggttcgtacgggggaaacctaagggtacgttttccaaccgtttaccgtaaccctaaacccgtattaccgaaccggtaccggtaaccggtacccgttacggtaaccgttaaacggttaccggttaaacggttaaaaggttttaacgtttttacgggttaaccttttaaaggttttttaaaccgtttacgttttaccggtacgttaaggtaacttaaacggtttaaaatttaaaaccgttttaaccgtttacgggtttacccctttaggttaccctttaccgggttaacgggtttccggggggaaacccgggggggtaaaccgtaaagggggtacgggtaaacgtaacggttaaaccgaaaacgggttaacggttagggtaccggtcgttaacggtaaccctaaccgttaacgttccgtttgttacccg

SEQ ID NO: 175629 - DNA, 711 bp, Homo sapiens
  misc_feature: GYAE6OF01DMYIT.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtcctccagcccacctgtctgtcgtcctaccgaaggggaaacgcgccctaccctctccgtgcgacgggccagtcaagtagttagttaataggccgtaacttacggccttacggtaaccagacgaacgtactaccgtcggaccgacggcctacccgacggtcctcctctactcctagtcggtacgactactccgtaccgacgggtacctaacgttcggtacctccccgagtcccgtaggttcaggtacggtcgtagggttcgggtcgtagggaacgtaggtacgttaccgtacgtcctacacctactaccacgtcgacgtccgtagcgtacgttacgtagtaacgtttgttttgtaacgtttagtttaacttcgtgttacgagttacgtaagttaacttaacgttacgttcgtttacctcgttaccgttaccgttacgggttaccggggacggggtacgtagggttacggaacggttaacgtaacggtaaacggtacggttagtaccggtacgtacgacctaccgtacgtttccgtcgtttaccg

SEQ ID NO: 175630 - DNA, 782 bp, Homo sapiens
  misc_feature: GYAE6OF01CLFLP.12.23.C01.1.454.CMB.1.raw
  modified_base (207)..(207): a, c, t, g, unknown or other
  misc_feature (207)..(207): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtcctccagcccaccctgtctgtgtctaccgaggggaaancgccacctctcctgcgagggccaggtcaaggagttacgttaagtacgtaccggtaactttaacggccgttacgggtaacccgaggacaaacggtaccgttaaccggcgggaccccgaaccgggtcccgttacccccgaacggggtccccttccccgttacctaaaccgtttcgtaacggttggtccgtacctaacgttacccgtaacccggacgggtacccttaaccgttcgggtaaccctaccccggagtccccggtaggtttaccacgggttggaccgtagggttcggggttcgtagggaccgtaggtacgttacctacccgttacctaccaccctaagtccgaacgcgtaccgccgtcgtaccgtattacgtacggtaaagtttcgtttgtactttaacgtttattacgttgtacgtagaacgttataaacgtttaacgttaacgttcggttacctcgttacgttacgtaccggggtttcggggaaccgggtaacggtaagggttcggaacgtaacgtaaccgaaacggttcgtacgggtgaccgacggtacccacgtattccgtcgttacc

SEQ ID NO: 175631 - DNA, 734 bp, Homo sapiens
  misc_feature: GYAE6OF01D1BA6.12.23.C01.1.454.CMB.1.raw
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
tcagatacgacgtacacgaccggtgctcgatttagtacacgtgattagggattgggggagaactgctcagttaggacccagacggaaccatggaagccccagcgcagcttctcttcctcctgctactctggcctaccagataccatggaanaaatgtgatgaancagtcctccagcccacctgtcctagtgtaccacgaaggggaaacncgccctaccctctccgtgaccgacgggcctaagtccaaggtagttcgttaaancggtcaacgttagaccgttaggaccaggtacaacgacgttaccgcggaccgtacggcccgttaccgacggtccctacctactaacgttcgtaagtcgggtacacgtacgttaccgtaccggacggtacctacggtacggacctaacccgttccgaacgtaccggtaggtacgtacgggtacgtacggtaggttccgggtcgtacggggactaacggtcctaacgtcctcgtaccacgctaccgcggtacacgtacctacggtacgtaccgtaagtaacgtttacgtttacgtaacgttagttttaaccgtagtcgtaacccgtagaccgtaacgtcgtaactaccgtacgtccgttaccggttacgttactaccggggtttaccgacggtaaccgtaccgtaggtcgtacggtaacgtaaccttacggaacgtacggttccagggttaccctaggtccctaggttaccgttc

SEQ ID NO: 175632 - DNA, 707 bp, Homo sapiens
  misc_feature: GYAE6OF01BQ92O.12.23.C01.1.454.CMB.1.raw
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaacgcgccaccctctcctgcagggccagtcagagtgttaatgcgtacttagcctaggtaccagcagataccgtggccaggcctcccaggcctcctcatctatggtnctatctaccgngggccagtggtactccagcctaggttcaggtcggacagggttcgggtcgtggggacaaggtacgttccaaccgtctaccgaacctagtaccgacgccgacgtcctagtcctaacggttacgttagtaaacgttactttttaggtaccgtttaacggttttactttaaccggttacgttacgtaaccgtaacgttaagttaaacgtttaaacgtttaaaccggtttcgggttttacccgttacggtttaccgttacccggttaccggggtttaaccgggggacccgggggggtaaaccgtaaacgggggtaagggtaacggtaacggttaaccgaaacgggtacgttagggtacggtacgtcggacctaaccgtacttccgtgttacccg

SEQ ID NO: 175633 - DNA, 621 bp, Homo sapiens
  misc_feature: GYAE6OF01BSOVI.12.23.C01.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccaccggagaaattgtgttgactcagtctccagccaccctgtctttgtctccgaggggaaanagcaaccctctcctgcgagggccagtcagagtgttaacagatacttagcctaggtaccagcagataccgtggccaggcctcccgaggcctcctcatctagtggtncatcctaccgagggcctacgtggtacncccagccgtaggttcagtggcgtaggtgggtctaggggactaggtacgttcactctacacctatcagcacgtcctcgactgtctagtaagttagtttgtacgttagtttacttacgttgtactacgcgtacggtcgtacgacgtaacgtcggtcccgttacgttaccgttacgtttccggaccggtacgggaaccgtacggtacgtacgggaacgtacgtaaccgtaacggtacgttcggtacggtacgtacgtacccgtacgtacgttcgttcgttccttaccg

SEQ ID NO: 175634 - DNA, 665 bp, Homo sapiens
  misc_feature: GYAE6OF01CG689.12.23.C01.1.454.CMB.1.raw
  modified_base (203)..(203): a, c, t, g, unknown or other
  misc_feature (203)..(203): n is a, c, g, or t
  modified_base (461)..(461): a, c, t, g, unknown or other
  misc_feature (461)..(461): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanacgccaccctctcctgcagggccagtcagagtgttaatagcgacttagccgtaggtaccagcagactaccgtcggccaggcctacccgaggcctcctcatcctagtggtcgctatcctaaccggacgggcctacgtaggtactcccgagcccgtaggttcgaggtcgcgtaggttcgggtacgtggggactaggtacgtttcacttccgtccgaacctagtcacgcacgtcctagcctagttaccgtagtaacgtttntttacggactttaagtttacttacgtcgttacagttaccttaagttaattaaacgtttacggttaccggtttccttaggttacccttaccggttacgggtttacccggggggaccgggggttaaccgtaaggggtagaacggtaaccgttaacggaaacggttcgtcgggtagaccgtcgaccctaccgtcttcgtcttacccg

SEQ ID NO: 175635 - DNA, 745 bp, Homo sapiens
  misc_feature: GYAE6OF01BPHOH.12.23.C01.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctccagccacctgtctgtgtctccgaaggggaaancgccaccctctcctgcacgggcagtcagagtgttaatgcgtacttagccgtaggtaccagcagactaccgtggccaggcctcccgaggcctcctcatctagtcggtncctactcctaccgacgggcctacgttcggtaacctcccgagtccgtaagggttccaggtcgacgtagggttcgggtcgtaggggacctaggtaccgtttacaccgtttacctaccgtaaccctaattccggaacgaccgacggtacccgtcggacgtacgttacgtaggttaaacggtttattttacggacgttttaacgttttaagtttccgttacgttacgtaaggttaaccttaaagttaaacgtttaaaccggtttaccggttttacccggtttaacccgttggttacccgtttaccgttaccgggggtttacccgggggaccggggggttaaaccgtaggggttaacggaacggtaacgtaaacccggtaaacggttaacgttggtaccgggtccttacggaacctaccgttacttcgttcgttaccg

SEQ ID NO: 175636 - DNA, 687 bp, Homo sapiens
  misc_feature: GYAE6OF01DG6HA.12.23.C01.1.454.CMB.1.raw
tcagatacgacgtacacgaccggtgctcgatttagtacacgtgattagggattgggggaggaactgctcagttaggacccagacggaaccatggaagcccagcgcagcttctcttcctcctgctactctggctccagataccactggaagaaatagtgatgaagcagtctcagccacctgtctgtgtctccgaggggaagacgccaccctctcctgcgacgggccagtcagagttagttaaagtcgcgtaacttacgccgttggtaccacgacgacgacgtaccgtcggccgacggccgtccgacggtacctcctctactcgtagtcggtcgtactactaccgtaccgacggccgtacgtcgtactcccgacgccgtacggttacgtacgtacggcgtacggtcgggtctacgggggggggggggggggacacggtacgtacgtacgtacctacacctactacgacgacgacgtccgtcgacgtacgtcgtagtaagttagtttacgtacgttagtttaactttacgttagtacgtacgtactaagttaattaacgttaacgttacgttaccgtcgtcgttacgttacggttaccggtacgggtaacgggtaacggtacggtacggtaacgtaacgtaacgtaaacgtaacgtacggtacggtacgtacgacaccgtcgtcgttacg

SEQ ID NO: 175637 - DNA, 914 bp, Homo sapiens
  misc_feature: GYAE6OF01EI1TU.12.23.C01.1.454.CMB.1.raw
  modified_base (226)..(226): a, c, t, g, unknown or other
  misc_feature (226)..(226): n is a, c, g, or t
tcagatacgacgtacacgaccggtgctcgatttagtacacgtgattagggattgggggaggaactgctcagttaggacccagacggaaccatggaacgccccagcgcagcttctcttcctcctgctactctggctcccagactaccactgggaagaaattagtgaatgaacgcagtcctccgagccctaccgttgtctggttcgtaccgtaccggaaggggaaacncgcccctacccttcgtccgtggacgacgggcccaagtcgaggtagttagttaaatggccgtactttacggccccgttaggtaaccgaggtacaacgtacgttacccggtcggacccgtaaccggtcccttacccgaacgggtccccttacccgtacttaacgtttccgtttaagggttcggttacgtaccgttaaccgttacccgttaacccggaacggggtacccctaacggtttaccggttaccctaccccgtaacggtacccggttacgggttaccgtagggttacggaccgtaggggtttacggggtacgtttacggggaacgttaacggtacggtttaccctaccggttacctaaccgtaaccctaacggttccgaacggttacccaccgggtaccttacggtaacccgttaacggttacttaaacggttaaaggttttaccggtttttacgtaacgtttaacgtttttaacgtttaccgtagttacgtaaccgttagttaaacgtttaacgttaaacgtttacccggtttcgtttaacccgtggttaacccgtttaccgggtttaccgggtttaccggggaacggggtaaccgtagggtacggtaacggtaaccgttaaacggaaacgttgggtaccgtacgggtacctacgtaaccgtaccttcgttcgttcgtttacccg

SEQ ID NO: 175638 - DNA, 764 bp, Homo sapiens
  misc_feature: GYAE6OF01A1P6H.12.23.C01.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaacgcagtctccagcccacctgtctgtcgtctcgaaggggaancgcccacctctcctgcgacgggcagtcagtagttagttaanacgcgtacttagccgttaggaccagactagtactaccgtgggacccacgggtccctacccgacggtccttcctactacgttctaggttcgggtatacctactaccgtaacccggtacgggtaccctaacggttacgggtaccctaccccgacggtccccgttaggtttcgaacggttcgggacgtaggggtcggtacgtcgggaactaggtacttccactcctaccacgtactacgtagaccgtacgtccgtagaccgtagtacgtaacgtaagtttacgtttcgtacgttttacgtttacgttacgttcgtactagtacgtaagttaacttaaacgttacgttacggtttccgtacgttaccgttaccggttacgggtttaccggggaacccgggggttaaacgtaggggttaacgggtaaaccggtaacgttaaaccggtaaaacggttcccggtaggtacccgggtaccttaacggacccttaaccgtttaccgttccggtttccgttaacccg

SEQ ID NO: 175639 - DNA, 708 bp, Homo sapiens
  misc_feature: GYAE6OF01C2S48.12.23.C01.1.454.CMB.1.raw
  modified_base (231)..(231): a, c, t, g, unknown or other
  misc_feature (231)..(231): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctgctcccagactaccacgtggaagtaaatagtgaataggaaagccagttccaccacgccctacctgtctgtcgtccacggaagggaaaccgcccacctctcnggcgacggactagtcagtagtattaagcgacgacttacgccgtaggaccagactagactacgcgcgacgcctaccgagtcctcctactacttctaagtcgtatcgacaacgtaaccgaaacggcctacgcgacctaccgaccgacggtactacggttacgaggtcggacgtagggttcgggtcggtggacctagtacctacgactacctacgacctacacgacgaccgtacgtacgtaacgtacgtacgttaaggttaactttacgtttaacgtactttaaagtttacgttaccgtgtaacgcgtaacgacggtcgtaaccgtacggtacggttccgttaccggtttacgttaccgttacgggtttaccggaacccggtaagggtacctaacgggttacgtaacggtaacgtaaaccgtaaccggtaaacggttcgttacggggccacggttaaccgccgttaaccgtgtttacccg

SEQ ID NO: 175640 - DNA, 726 bp, Homo sapiens
  misc_feature: GYAE6OF01CNTJL.12.23.C01.1.454.CMB.1.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctcagcccaccctgtctgtgtactaccgaaggggaaatacgcctaccctttcngcgacggccagtcagtagtnttaangcgtacttaggctcggtacagacagactcgtcggaccaggcctacccgaggtcctcctacactcgtagtggtanaccgtactaccgtaaccgaacggccgtagttcggtacctacccgacggaccgtacggttgtaggtcggtacgtagggttcgggtacggttacgggaaacgtaggttaacgtcctaccgtaccttaaccgaccgttaaacacgtaacgactaagtacccggtatacgtaacggttaccgttaagtaagttaagtttacggacttacggtttaattaccgttggttaccaacggtacttaaacgggtaactttaaacgtttaacgttaaccggtttccttacggtaccttaccggttaacgggttacccggggtaccgggggtaaacgttagggaacggttaacgaacgttaaacgaaacggtacgttgacggtcgacgtacctacactcgttagtccgttaaccg

SEQ ID NO: 175641 - DNA, 740 bp, Homo sapiens
  misc_feature: GYAE6OF01B4YZM.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggctcccagactaccactggagaaatagtgatgaagcagtctccagcccaccctgtctgtgtcctccgaaggggaaagcgcccaccctctcctgcgacgggccagtcagtagttagttaatacgcgtacttacgcctaggtaccagcagactaccgtcggaccacggcctaccgacggtcccttcccactacttacgtacggtcggtacgacctaacgttccgtaacccggacgggtccctacgttaccgggtacctaccccgaggtcccgtaggttacgaggtcggtacgtagggttcggggttacgtaggggaaccgtaggttaaccggttacctaccgttacccgttaacctaacccgtaacgttacggaaccgtaccgtaccggtcccgtacgtacgtaacgttaccgttaaggtaagtttacgttttacgtacgttttaagtttacgtttagtacggtacgtataacgttaattaaacgttaacttaccgttcggttactcgtacgttcggtacgggttccgggaacgggtacggacggaaggtacgtaacgtaaccgtaacggtactgggtacgtacgtcgacctacgtgttccttgttacccg

SEQ ID NO: 175642 - DNA, 602 bp, Homo sapiens
  misc_feature: GYAE6OF01EYKHU.12.23.C01.1.454.CMB.1.raw
  modified_base (204)..(204): a, c, t, g, unknown or other
  misc_feature (204)..(204): n is a, c, g, or t
  modified_base (355)..(355): a, c, t, g, unknown or other
  misc_feature (355)..(355): n is a, c, g, or t
  modified_base (588)..(588): a, c, t, g, unknown or other
  misc_feature (588)..(588): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgttaatagcgacttagcctggtaccagcagatacctggccaggcctcccaggctcctcactctagtggtgcatcctaccgacgggccacgtggtactcccgagcctaggttcagtcggcgnggtcggggtctggggacaggtacgttcacttctcaccatcagccgacgcctggcctaggtctaggaagttattttgaccttagttttacttacgttggtacagctaagttaattaaacttaacgtcggtttccttacgtcttacgttacggtttccgggtaccggggggtaactaacgggtaggaagtacgtaaccgtaaacggtaacgtggtcggtcgtacggccaaccctnttccgtgtttaccg

SEQ ID NO: 175643 - DNA, 665 bp, Homo sapiens
  misc_feature: GYAE6OF01DJQLF.12.23.C01.1.454.CMB.1.raw
  modified_base (166)..(166): a, c, t, g, unknown or other
  misc_feature (166)..(166): n is a, c, g, or t
  modified_base (474)..(474): a, c, t, g, unknown or other
  misc_feature (474)..(474): n is a, c, g, or t
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaancagtctccacgccctacctgtctgtcgtctaccggaaggggaaactcgccctacccgtctccgtggacgacggggaccctagttcaaggtagtttagttaaagacgaccgtaactttacggccgttaggaaccagcgaagtacctaccgtcggaccaggtccctcccgacggtcctcctctatacgtacgtggtcactactaccgtaccggaggtccctagttcggtacctccccgacggtccgtacggttacgaggtcgacgttacgggtcggtacgtagggactacgtcgtctactctacacctancgacgcacgctgactgtacgtagtacgttnttacgtattaacgttttncgttagctacgacttaagttaattacttcgttacgttctacgtccttacggttaccgggtcgggaccgggtagtacgggtacgtacgtaacgtacgtaaggtcgtcgggtacgcgtaccacgtaccttacggtcttcgtaccg

SEQ ID NO: 175644 - DNA, 769 bp, Homo sapiens
  misc_feature: GYAE6OF01B7SC0.12.23.C01.1.454.CMB.1.raw
  modified_base (124)..(124): a, c, t, g, unknown or other
  misc_feature (124)..(124): n is a, c, g, or t
  modified_base (160)..(160): a, c, t, g, unknown or other
  misc_feature (160)..(160): n is a, c, g, or t
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
tcagatacgacgtacacgaccggtgctcgattttagtacacgtgattagggattgggggaggaactgctcagttaggacccagacggaaccatggaagccccagcgcagcttctcttcctcctnctactctggctcccagataccatggaagaaatagtnatgaagcagtctccagtcccacccgtgttctgtcgtctaccggaaggggtaaacncgcccacccttctcctgcgagggtccagtcaagtagtagttaatcgacgtacttacgcgtaggaccagtacgactaccgtggaccaggtccctccgngtccctacctactattcgtagtcgggttctactacgtaccgtaccgaaccgggcctaagttcggtaacccttccgacggttaccctagggtttcccgaggttccggtaagtcgggggttgtaccggttaagggcctaacgtaccgttcgtaccctcgttaaccaacgtcgtaaccgagcccgtacggtaccgtaacgtcgtaacccgtaagggttaactttaagttttccgtaaggtttttaaacctttggtttaccttacggtacgtaccgtacgttacgggaaccgttaacgtcccgttaacgggttccggtttcccgttttaccggtaacgtttcccggttacggtaccgggtacggaccgtaaacggtccggttaacggaaaccgttgttaaaccgggaacgtttccgacggtcgtacgtaacgtcctaaaccgttcggtcttacgtttaccc

SEQ ID NO: 175645 - DNA, 670 bp, Homo sapiens
  misc_feature: GYAE6OF01CDU4J.12.23.C01.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (337)..(337): a, c, t, g, unknown or other
  misc_feature (337)..(337): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgtaanagcgacttagcctggtaccagcagactaccgtggccaggcctcccgaggcctccgtcattcctagtcggtgcatcctaccgcgggcctacgtcgtacncccgagccgtaggttcgagtcggcgtagggtcgggtcgtaggggacaggtacgtctactcgtaccacctatccaggctacggccgtacgcgtacgttgtaggtaacgttnttttgacctttaggttttactttacgtntaacgtctaacgtaagttaacttaaacgttacgtttccgggttaccttcgttaccgtttacccggttaccgggtttacccgggggggacgggggtaacccgtaaagggttcggggtaaacgtaacggttaaaccggaaaacggttcggtacgggtacggtcgtacgaaccctaccgtacgttcgttcgttacccg

SEQ ID NO: 175646 - DNA, 757 bp, Homo sapiens
  misc_feature: GYAE6OF01C6AV4.12.23.C01.1.454.CMB.1.raw
  modified_base (150)..(150): a, c, t, g, unknown or other
  misc_feature (150)..(150): n is a, c, g, or t
  modified_base (205)..(205): a, c, t, g, unknown or other
  misc_feature (205)..(205): n is a, c, g, or t
  modified_base (334)..(334): a, c, t, g, unknown or other
  misc_feature (334)..(334): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctccagataccactgganaaatagtgatgaagcagtctccagcccaccctgtctgtgtctccgagggggaacngcccacccgtctccctgcacgggccagtcagagtgttaatagcgtacttacgcctaggtaccagctagactaccgtggccaggcctcccgaggtcctcctcattctagttggtcgtacatccctaccgngggcccaacgttcggtaacctcccgaacgtcccgtaggttccacgggttgggccgtagggttcggggtcggtttacggggaaccaagggttcgttccgaacttccgtaaccaaccccgtaagttccgaacgaccgaccggtacccgtaggacccgtaaggttccttaaggttaaacgtttcggttttacgtaacgtttttaacgttttaactttacgtttaggttaccgtaagtaccttaaggttaacttaaacgtttaaccgttcggttttaccgtacgttccctttaacccggttacccgggtttacgggggtacccgggggtaacgtaaacggggttgggaaaccgtacggtaacccggaaaacggttcgttacgggtacgtacgtaccggtacgtaaccctagttccgtttacgttccc

SEQ ID NO: 175647 - DNA, 808 bp, Homo sapiens
  misc_feature: GYAE6OF01EF6HD.12.23.C01.1.454.CMB.1.raw
  modified_base (211)..(211): a, c, t, g, unknown or other
  misc_feature (211)..(211): n is a, c, g, or t
  modified_base (803)..(803): a, c, t, g, unknown or other
  misc_feature (803)..(803): n is a, c, g, or t
tcagatacgacgtacacgaccggtgctcgattttagtacacgtgattagggattggggggaggaactgctcagttaggacccagacggaaccatggaagccccagcgcagcttctcttcctcctgctactctggcctccagactaccatggaagaaatgtgatgaagcagtcctccacgcccaccgttgtctgtcgtctcggaaggggaancgccctaccctctccgtgcgacggcctagtcagtaagttagttaagacggtccgtacgtttacggcccgttagggtacccaggtacgaacggtaccttacccgtcgggtacccgcgggtaccctcccggacggtccctaccctactacgttcgttaggttcgggttacgaccgtacttacccgtaccgggacgggtccctacgttccggtaacctccccgacggtccgtaggttcgaggtcggtcgggtaggttcgggtcgtacggggtactaggttacgtacctacctacgtaccgacctacgtacgacgtactaccggtcctacggtaccgttacggttaaccgttaggtaacggttttaacttttcgtaaaggtttttaacgttttaacgttcggttaacgtttacgtaacgttaagttaaacggttaactttaaacggtttccggttttaaccgggtttacctccgggtttaacccgtttacgggttacccgggggtttacgggggaaccgggtaacgtagggtaaccggacgtaaacgtaccggtaaaggtcggtacggtcgtcgtacaccgtacgtacgttcgttntcccg

SEQ ID NO: 175648 - DNA, 724 bp, Homo sapiens
  misc_feature: GYAE6OF01A2LK1.12.23.C01.1.454.CMB.1.raw
  modified_base (245)..(245): a, c, t, g, unknown or other
  misc_feature (245)..(245): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctagtgtctccgaaggggaaacacgcccaccctctcctgaccgagggccagtcagagttnttaatagcgtaacttagccttaggaaccagacagtactacctggaccacggcctacccgaggcctaccgtactacgtacgtattgggtacacctactccgtaacccggagggaccctacgtacgggtaccttaccccgaggtacccgtaaggtttacgtacgtaccgggtacgtacgggttcggggtacgtacgggaacgtacggtaacgtttaccacggttttacccaccgacctactaaccgacgcaccgtacgtcgaactacggtactaggtaacttattttcgacgtttaagtttacttacgtgtaccgtaagtaccgtaataaacgttaacgtaacgttcggttacctacgtcttaccggttacgttccgggggaccgggtaactaaacgggtggaaacgttacgaaacgggttaaaccgtaccgtagggcccgtacgtaccgtacccttaacgtaacttccgtcggttaaccc

SEQ ID NO: 175649 - DNA, 731 bp, Homo sapiens
  misc_feature: GYAE6OF01C2SBA.12.23.C01.1.454.CMB.1.raw
  modified_base (157)..(157): a, c, t, g, unknown or other
  misc_feature (157)..(157): n is a, c, g, or t
  modified_base (216)..(216): a, c, t, g, unknown or other
  misc_feature (216)..(216): n is a, c, g, or t
  modified_base (326)..(326): a, c, t, g, unknown or other
  misc_feature (326)..(326): n is a, c, g, or t
  modified_base (379)..(379): a, c, t, g, unknown or other
  misc_feature (379)..(379): n is a, c, g, or t
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
  modified_base (486)..(486): a, c, t, g, unknown or other
  misc_feature (486)..(486): n is a, c, g, or t
tcagatacgacgtacacgaccggtgctcgatttagtacacgtgattagggattggggggaggaactgctcagttaggacccagacggaaccatggaacgcccagcgcagtcttctcttcctcctgcttactctggcctcccagactaccactggaanaaatgtgatagaagcagtcctaccacgcctacctgtctgtcgtctaccgaaggggaaanacgcccaccctctacctgacacgggccagtcagtagttataatgactacttacgcgttaggaccagtcaagactaccgtggacccaggtcctaccgacggccttacctanaacttctacgtggtaccactactaccgtaccgagggtccctaacgtcgttacncccgaacggccgtagtccgaggttcggacgtaggtcgggtacgtggaacnggtacgttcacctctacaccgtancacgcacgtcgtgactagtacgtagtaaagttntttacgaacgtttatttacgtacgttacgtagtaactacgttaaagtttaaaccgttaaacgttcgtttaccgggttcctacggtttaccttaaccgggtttaccggggttaccggggggtaacccggggggtaaaccgtaaagggtacgggtaaacgttaaaccgtaaaccggttaaacccgggtaagttcgggttaccggacgtttacgaacccgtttacctacgttcctttaccggtaaccc

SEQ ID NO: 175650 - DNA, 772 bp, Homo sapiens
  misc_feature: GYAE6OF01A5RFO.12.23.C01.1.454.CMB.1.raw
  modified_base (205)..(205): a, c, t, g, unknown or other
  misc_feature (205)..(205): n is a, c, g, or t
  modified_base (759)..(759): a, c, t, g, unknown or other
  misc_feature (759)..(759): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctccacgccaccctgtctgtgtctcgaggggaacncgccacctctcctgcgagggccagtcagtagttagttaagtacgccgtacttacggccgttacggtaccagccgaagtacgtacccgtcgggcccaacgggtccctccccgaaggtcccttccctactaacgttccgtaaggttcgggtacgactaaccttcccggtaacccggacggggtaccctaacggttcgggtaacctcccccgtaacggtcccgtacggtttaccgagggttccgggaccgtaaggggttcggggtaccggtacgggaaaccgtaggttaccgtttaccccaccgtttcccgtaaccctaacccgtacttaccgacggtccccgaacgtccccgtagaccgtagttacgttaaggtaagtttacgttttagtaccgtttaagttttacgttacgttcgtaactacgtaacttaagttaacttaacgttacgttcgggttccctaggtacccttacggttaccgggttccgggggaaccggggtaacctaggggtacggacgtacgtaagaaccggtagtcggtcgcgtcgacctactnttcgtcgttaccg

SEQ ID NO: 175651 - DNA, 802 bp, Homo sapiens
  misc_feature: GYAE6OF01ECH90.12.23.C01.1.454.CMB.1.raw
  modified_base (154)..(154): a, c, t, g, unknown or other
  misc_feature (154)..(154): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggcctcccagactaccactgganaaatagtgatgaagcagtctccacgccctaccctgtctgtcgtccgtaccgaaggggaaacacgccccaacccttctccgtggccgacggggcctaggtacaggtagttagttaaacgtacggaccgttaacttaacggcccgttacgggtaacccaggtcaaaggtaaccgttacccgtcgggacccgtacgggcccttaccccgacgggtcctttcccctactaacttcgtaagttcggggtctacctacttacccgtaacccgacggggccctacgttcggtaacctcccgaacggtcctacgggtcaggtacgggcgtagggttcgggtcgtagggacgtagtacggttaccaccttcgtaccacctagtaccacgccgtacgtccctggaccttacgttacgtaaggttaacgttcgttttacgtacgttttaacttttacgttaacgttcgtaacgttaagtaccgtaatttaaacgttaacgttaccgtttcgggtttaccctcgttaccgttaccgggttaccgggttaccgggggtaaccggggggtaacgtaacggggttacggaaacgtaccgtaaacgtaaacgggttcgtacgggtacggtcctacggaacctacctcggttccgttcggttccc

SEQ ID NO: 175652 - DNA, 851 bp, Homo sapiens
  misc_feature: GYAE6OF01B8UCC.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgagggaaanacgccaccctctcctgcgaggccagtcagagttgttaatagacgtacttacgcctaggaccagcaagactacccgtggaccaacgggtcctacccgaggcccttcctacagtttactaacggttggggtactacctaacgttcccgttaacccggacggggacccttaaccggttacgggttaaccttaccccgaacggttcccgtaaacggggtttcgacggtttagggccgtaaggggtttcggggtaccgttaaggggaaccgtaagggtaccgttttacccgaacctttaccccgtaacctaaacccgtaattacccggaacggtaccctacgggtccccgttaggacccgttaacggttaccgttaaagggttaaagtttacgttttttaccggaaacgtttttaacggtttttaacgtttaaccttggttaaccggtaagtaaccttaaggtttaacctttaaacgtttaacggtttccgtttaccgtcgttaccgtaccgtttacggggttaccggggggtaccggggtaaaccgtaggggtaacgggtaaccgttaaagtaaccccggtaaaacggttccggttagggtaacccggttcgtacccgtaactaaccggttaccttttggtaacccgtttcg

SEQ ID NO: 175653 - DNA, 687 bp, Homo sapiens
  misc_feature: GYAE6OF01D1XZC.12.23.C01.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (321)..(321): a, c, t, g, unknown or other
  misc_feature (321)..(321): n is a, c, g, or t
  modified_base (400)..(400): a, c, t, g, unknown or other
  misc_feature (400)..(400): n is a, c, g, or t
  modified_base (671)..(671): a, c, t, g, unknown or other
  misc_feature (671)..(671): n is a, c, g, or t
  modified_base (677)..(677): a, c, t, g, unknown or other
  misc_feature (677)..(677): n is a, c, g, or t
tcagatacgacgtacacgaccggtgctcgatttagtacacgtgattagggattgggggaggaactgctcagttaggacccagacggaaccatggaacgccccagcgcagcttctcttcctcctgctactctcggcctcccaaggactaccgacgtggaagtaaatggtagatagaagtcgacgtcctaccacgcctacctgttctagtcgtcgacggaagggaanccgaccacctcncgtgacgacggcacgagtagagttagtaancgacgtactacgcgtacgtacacgacaagactaccgcgacgtacgtcctaccgngtacctcgtatacgctacggtgaccgtactacgtaccgtaacggcggtactacgtacgtaccacgtacgtcgtacggtnacgtgacgtgggtcgagtacggaatacgtagtcctactacgtaccgaactcgacgtacgtacgccgtacgtacgtacggttagtaaccgtaagttaaccggtttagtttaccgtttaacggtttaaactttacgtttacggtaactacgtaagtactaaacgttaagttaaccgtttaacgttcgttaccgttacgtaccggttaaccggtcgggttacgggaaccgggtaggtacgtaagacgtaacgacgtagtcgagacgacgacganaccgtntccgtagtcg

SEQ ID NO: 175654 - DNA, 701 bp, Homo sapiens
  misc_feature: GYAE6OF01ECYXH.12.23.C01.1.454.CMB.1.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagactaccactggaagaaatagtgatgaagcagtctccagccaccctgtctgtgtctccggaagggaagacgccaccctctcctgcgaggggccaggtacagtagtgtttaaacgagcgtactttagcccgtaggtaccaagctaagtacgttacccngggcccaggtcctaccgaggtcctactcctatctagttggngacacgtcgtaacgngggcctagtcggtacnccgtacgccgtaggtcnggtcgacgtaggtggtctagggaactggtacgttcacttcaccgactaactcgacgccgacgtccgtgtaccgtaggtctaaggtaaagtttcgtttaggtactttagttttaacttacgttacgttacacgtacgttaacgtaatttaacgtacgtttccggttacctacggttccgttaccggttacgggttccgggggaaccggggttaaacgggtaggttaagggaaccggtaacttaaaccgggtaaacgtccggttaagggtcccggtacgtaacccggtactaaaccccgtggttcccgttcggttaccc

SEQ ID NO: 175655 - DNA, 703 bp, Homo sapiens
  misc_feature: GYAE6OF01DW55L.12.23.C01.1.454.CMB.1.raw
  modified_base (206)..(206): a, c, t, g, unknown or other
  misc_feature (206)..(206): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccacgtggaagaaatagtgatgaagcagtctccagccaccctgtctgtgtctccgaaggggaanacgccaccctctcctgcgacgggccagtcagagttagttaaatgacgacttagcctaggtaccaggtcaagactaccgtggccctaacggcctacccgaggcctccctctattcgtagtgggtctacacttacctaccgagggtcctacgttacgtacgtacccagccgtaggttacaggttcggactagggtcggtctgggactaggtacttccgacttctacaccgtattcaacgacctacggcccgtgaccgtagttcgtaaggtaacgttgttttaacgctttaagttttacgtactcgtaactacgacgttaaagttaatttaacgtaaacggttcgggtttccttacggtaccgtttaccggttaccggttttaccgggggggaaaccggggtaacctaaaggggttcggtaaccggaacttaaacccgggaaacgttaacgggtcgtacgggtaccggtcctacggagtaacctttcgttagttaccccc

SEQ ID NO: 175656 - DNA, 892 bp, Homo sapiens
  misc_feature: GYAE6OF01ETPD8.12.23.C01.1.454.CMB.1.raw
  modified_base (155)..(155): a, c, t, g, unknown or other
  misc_feature (155)..(155): n is a, c, g, or t
  modified_base (218)..(218): a, c, t, g, unknown or other
  misc_feature (218)..(218): n is a, c, g, or t
tcagatacgacgtacacgaccggtgctcgatttagtacacgtgattagggattgggggaggaactgctcagttaggacccagacggaaccatggaagccccagcgcagcttctcttcctccttgctactctggcctcccagactaccacgtgganaaataggtgatagaagcagttcctccgacgcccacccgtgtctgtcgtctacgaaggggaacncgcctaccctcgcctgccgacgggcctacgtcgagtaggttagttaaacgacggtcgtacgtttacggccttagggtaacccaggacagtacgtccgcgaccgacggtccacccgtagcccttcgctacgtacgtacgtggtacgactacgtaccgtaccggacggtacccttacggtccggttacctcccgtaacgggtacccggtaggttccggtaaggtccgggacggtcgggttacgggttcggaggtaaccgtacggtttacggttacctacccgttaccgtacccgtaacctacgtacgtaccgtaccgtaccggttacctttaggttacgttaacgttaacgggttaacgttttacgttttacgtaacggttttaacggtttttaaccgttaacggtcgtttaaccggaacgtttaaacgttaaacgttttaacggtttaaaccggttttaccggtttaccggttttacccgttaccgttacccgggtttaccgggtttacccggggtttacccggggggaaccgggggttaaacccgggttagggaacccggttaacggttaaacccgtaaaccgggtaaacggttacggggtacccttacgggggtaccctaccggaaacccgtttaccgttaaccgtcggttttacccgttaccggtttacccc

SEQ ID NO: 175657 - DNA, 854 bp, Homo sapiens
  misc_feature: GYAE6OF01EYAHH.12.23.C01.1.454.CMB.1.raw
tcagatacgacgtacacgaccggtgctcgatttagtacacgtgattagggattgggggaggaactgctcagttaggacccagacggaaccatggaagccccagctcagcttctcttcctcctgctactctggctcccaggtgccaccggagtaaattctgttgacactagtcctccagccctaccccttggtcttttgtcctaccgaagggggtaaagacgccctaccctttctcctggccgaacggggccctaggtcaaggtagttcctttaggacccttaacccttaacgttaccgaccgttacgggtaaacccaaaaccgaacggtaaacccgtcggacccgacggtacccttccccgaacggtcccttccctactacttaccgttaagtgtaacgttacgacctaaccggtaaacccggtaaaaaccggggcccctaacggtaccgggacctacccgttaccccgtacggtaccggttacggttacgtaacgggttcgggacgttacggggtttcggggtcggttacgggggtacctacggttacctttacctacccgttcctaccgtaacctacgtacgaccgtacgaccgtactaacggactaccggtagtaacgtttacgtttacgtacgtttaacgttttacgttacgttacgtacgtacgacgtacggacgttaacgaccgttaccgtccggtccgtttacggttacccgtttaccggttttaccggggaaccgggttaaccgggaacgttacgaacggttagtaacgtaccgtaaacgtaacggtacgtaggtccggcgtacccgcgttaaccgttacttcgtacctttctccgtccttccccg

SEQ ID NO: 175658 - DNA, 740 bp, Homo sapiens
  misc_feature: GYAE6OF01ASY8J.12.23.C01.1.454.CMB.1.raw
  modified_base (69)..(69): a, c, t, g, unknown or other
  misc_feature (69)..(69): n is a, c, g, or t
  modified_base (378)..(378): a, c, t, g, unknown or other
  misc_feature (378)..(378): n is a, c, g, or t
  modified_base (527)..(527): a, c, t, g, unknown or other
  misc_feature (527)..(527): n is a, c, g, or t
tcagatacgacgtacacgaccggtgctcgatttagtacacgtgattagggattgggggaggaactgctnagttaggacccagacggaaccatggaagccccagcgcagcttctcttcctcctgctactctggctcccagataccactggagtaaatagtgaatgaagccagtctccaacggtccaccctgtcgtcgtcggtcctaccgaggggaaacacgccacccgtctccgtgccgacgggccagtcgagtacgttagttaacgtagacgtacgttacgtccgtagaaccacggtaccaagtacctaccggtggacccaggcccgtaccgcgtcctaccgtctaacgtccgtagtggtcacctactccgtaacggnggtacccagttacgacctcccgtaaggtccgtacggttacgacgggtacgtacggtggtcccggggtacgaacgggtcgaagttcgtacctaacgtcctacacgtacgacgcgtactacggctacgacgtacgttagtagtaacgtttnttagtaccgttaagttacttacgtacgtagtaagtacgtaagttaacgttaataccggtttacgttacgtacgtactttaactcccggtttaacggaccgggggtaccgggtaaccgggaacgggttacggtaaaccgtaacggtaaaccggtaaacggttacgttacggtacggtaaccgtccgtaaaccggtactaccggtaaccgtttcg

SEQ ID NO: 175659 - DNA, 928 bp, Homo sapiens
  misc_feature: GYAE6OF01EZW4B.12.23.C01.1.454.CMB.1.raw
  modified_base (204)..(204): a, c, t, g, unknown or other
  misc_feature (204)..(204): n is a, c, g, or t
tcagatacgacgtacacgaccggtgctcgatttagtacacgtgattagggattgggggaggaactgctcagttaggacccagagggaaccatggaagccccagctcagcttctcttcctcctgctactctggctcccaggtgccaccggagaaattctgttgacacagtctccagccaccctgtctttgtctccgaggggaaancgccaccttctcctgcgagggccagtcagacgttcttagcaaccttacttacgccttaggtaccaacgacgaaaccgtggacccaggcctcccgaggcctcctcagtctactgactgcaacgtaccgaaaaacgggtccctaacgtcgggtaccaacttaccccgagtacccgtagggtttaccaacgggttcgggaccgtaggggtccggggttacggtacgggggtacctaagggttaacccttttaccggtaacctttacccgtacccgtaaacccgtaacgttacccgtacggacccgtaacggtaacccgttaacgggtaaccgttaccccggttaaggttaaaccggtttaacgttttttaccggtaaccgttttaaacggttttttaactttaacccgttacggtttaacccggtaaggtacccgtaacgggtacccggtttaacggaaccccgttaaaccgggttacccggggttaccccgtttttaacccgggggtttaaccttttaacccggggttttttaccggggaacccccgggttaaacggggggttaaccccctaaaggggttacccggttaacgggggtaacgttaaaacccggttaaaccggtaaaaacccggttaaccggttaacgggtaccgggttaccgtacggtaacccgtacccgtaatttaccgttacgtttaccctttaccgtacccgttttacccccgg

SEQ ID NO: 175660 - DNA, 849 bp, Homo sapiens
  misc_feature: GYAE6OF01C9PM4.12.23.C01.1.454.CMB.1.raw
  modified_base (165)..(165): a, c, t, g, unknown or other
  misc_feature (165)..(165): n is a, c, g, or t
  modified_base (367)..(367): a, c, t, g, unknown or other
  misc_feature (367)..(367): n is a, c, g, or t
  modified_base (565)..(565): a, c, t, g, unknown or other
  misc_feature (565)..(565): n is a, c, g, or t
  modified_base (799)..(799): a, c, t, g, unknown or other
  misc_feature (799)..(799): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactcctggcctcccagactaccacgtggaagtaaatgtanagtagaacgcacgtcctccgagcccaccctgtctgtacgtcctccgaaggggtaaactcgccctaccctcctaccgtggaccgacgggtcccgtaggttacgaaggtaaccgttagttaaaagtcggccgttaagtaaccgtccgttacggggaacaaggccgaaggttacctaaccgttccgggtacccgaacggtccccncccggaaccggttcctaacccggtttcacttacccggtttagtacgggtactacttaactcccgtaccgaggggaacccccttaggttaccggtaaaccctccccgtaaaggtcccgtaaggtacgtacggtccggtcgtaagggttcggaccgttagggacgtaaccgttcggttcctacgtaccttacgtaacccncgacgtaccgaccgtctccgtagaccgttacgtagtacgttaaacggttgtttacgtacttaacggttttacttacgtaccgttaaggtacccgtagttaacgttaaagtttaacctaacggttttcccggttcctacggttaccccgttacgggtttaccgggttacccgggggtaaccccggggtaaggtaaacggggttccgaaagttaaccgggtacgttaaaccgggtntaaccgggggttcacgtaccgtacgtacccctgttaccggttcttacccg

SEQ ID NO: 175661 - DNA, 730 bp, Homo sapiens
  misc_feature: GYAE6OF01A81SE.12.23.C01.1.454.CMB.1.raw
  modified_base (160)..(160): a, c, t, g, unknown or other
  misc_feature (160)..(160): n is a, c, g, or t
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (392)..(392): a, c, t, g, unknown or other
  misc_feature (392)..(392): n is a, c, g, or t
  modified_base (477)..(477): a, c, t, g, unknown or other
  misc_feature (477)..(477): n is a, c, g, or t
  modified_base (621)..(621): a, c, t, g, unknown or other
  misc_feature (621)..(621): n is a, c, g, or t
  modified_base (646)..(646): a, c, t, g, unknown or other
  misc_feature (646)..(646): n is a, c, g, or t
  modified_base (702)..(702): a, c, t, g, unknown or other
  misc_feature (702)..(702): n is a, c, g, or t
  modified_base (722)..(722): a, c, t, g, unknown or other
  misc_feature (722)..(722): n is a, c, g, or t
tcagatacgacgtacacgaccggtgctcgatttagtacacgtgattagggattgggggaggaacgtgctcagttaggacccagacggtaaccagtcggaagcccccagcgcagtcttctcttcctctgcctactctgcctcccagactaccacgtggaanaaatcgtgactagaagccagtcctccagccctaccctgtctagtcgtctcggaagggaacncgccctacgtcctactgccgacggtcctaggtccaggtagttacttaagcgccgtaacgtttgccgtagttaccngactagactaccgngcctacggcctccgagcctaccgtactntacgtagtgtacnctactccgtaacgaccgggtccaggttcggtaacctcccgnggttaccgtagttcgaacggttggacgtgggttcgggtaccgtagggaaaccctagggttaccccttcaaacttccccggtaacncttaccggtaccgagacccgacggttccgtacgaccttaagggtactaacgggttaagttacttttgggaaccttttagggttaaactcggttaccgtatacggtataaacgtatttaaccggtaagttcgttccggttacgtnttaacccgggtcgggttaccggggngggtaacccgtaggtcggttaagaccgtaacgtaacccgaggttcggcgttaaccncgacccgtattagtccgttnttaacccg

SEQ ID NO: 175662 - DNA, 889 bp, Homo sapiens
  misc_feature: GYAE6OF01CVBN5.12.23.C01.1.454.CMB.1.raw
  modified_base (155)..(155): a, c, t, g, unknown or other
  misc_feature (155)..(155): n is a, c, g, or t
  modified_base (210)..(210): a, c, t, g, unknown or other
  misc_feature (210)..(210): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggcctcccagactaccacgtggaanaaatagtgatgagcagtctccagcccacctgtctgtgtcctaccgaaggggaacncgccaccctctccgtagcgacgggccagtacgagaggttagttaatacgccgtaacgttagccgtaggtaaccaggacaagtacgtaccgtcgggaccacggtccctacccgaggtcccctcctacctacgtttccgttaagttcgggttacgacctaacgtttacccgaacccggggtacgggtaccccttaaacgttcccggggttaaccctacccccgtaacggtccccgggttaaagggtttcccggaacggtttccggggtacgggtacggggttcggggttacccggtaaggggtaaccgtaagggttacccttacccgttaccggtaccctaccgtaccctaagttaccgaaccgaccgtaccgtcccgttaggtaaccgtacggtttaccgttaagttaaaacggtttccgtttttacgtaaccggttttactttttaaacggttaccggttacgttaacgtacgtaacgttaaggtttaaacttaaaacggtttccgttttacccgggtttataacccgttccgttaccgggttaccgggggtttccgggggaaccccgggggtaacgttacgggggtacgggtaacgttaaccggtaaccggttaaacggtacggttacgggttacgtacctccgtaacccgttaaccgtacttcccgttcggttaccc

SEQ ID NO: 175663 - DNA, 789 bp, Homo sapiens
  misc_feature: GYAE6OF01EH6N6.12.23.C01.1.454.CMB.1.raw
  modified_base (156)..(156): a, c, t, g, unknown or other
  misc_feature (156)..(156): n is a, c, g, or t
  modified_base (380)..(380): a, c, t, g, unknown or other
  misc_feature (380)..(380): n is a, c, g, or t
tcagatacgacgtacacgaccggtgctcgatttagtacacgtgattagggattgggggaggaactgctcagttaggacccagacggaaccatggaagccccagcgcagcttctcttcctcctgtctactctggctcccagataccacccgtggaanaaatagtgagtgaagctacgtcctaccgacgccctacccgttgttcgttcgtcgttaccgtaccggaaggggaaacgaccgcccaacccttcctccgtcggaccgacgggctacgtacgaggtacgtttagtaacgtacgtacgtacgttacgtaccgtcggtaccagcctaggactaccgtcgccgtagcctaccgcgtctcctatctactacgtcgggtacnctaccgtaccgcgaccggctacgtaccgtacgtcccgaggtctaggtcggtgtcgggagttagggcggtcgaagacgtggtactccctgttccaacttacggtactcggacgtacgtacccggtccgacggtaccgttagtacgttaacggttagttttaacgtttacggttactttaacgtttaccgttaacggtggttaacgtaacgtaacgttaaacggttaacttaacgttaacccggttcgtttaccggtaccggttaccggttaacccgggttacggggttaccccgggggttaaggggtaaccgggttaaacgggttagggtaaaccggtaccgtaaaccgggttaacggacggtccggttacggtcgtaaccgtacgttacgtacgttcgttcttacccgg

SEQ ID NO: 175664 - DNA, 824 bp, Homo sapiens
  misc_feature: GYAE6OF01EGRXR.12.23.C01.1.454.CMB.1.raw
  modified_base (220)..(220): a, c, t, g, unknown or other
  misc_feature (220)..(220): n is a, c, g, or t
  modified_base (803)..(803): a, c, t, g, unknown or other
  misc_feature (803)..(803): n is a, c, g, or t
  modified_base (810)..(810): a, c, t, g, unknown or other
  misc_feature (810)..(810): n is a, c, g, or t
tcagatacgacgtacacgaccggtgctcgatttagtacacgtgattagggattgggggaggaactgctcagttaggacccagacggaaccatggaagccccagcgcagtcttctcttcctcctgctactctcggcctcccagactaccagtggaagaaatagtgatagaacgcagtctaccacgcccaccctgtctcgtgtacctaccggaaggggaacnccgtccctacccttcgtcccgaggaccggacgggcccaaggtacgaggtagtttagttaaacggtacgccggttaacttcgggtaccctacgggtaaccacgacgtaacgtactaccggtcggacccgtacgggcccttacccgagggtcccttacccgtacttcgtaccgttacggtgggttaccaccgttaccgttacccggtaacccgggaccgggtacccctttaggttacccggtacccctacccgggtacgtacccggtagggtttaccgacgggtggcggtacggggttcgggaccgtttaggggaacctaagtttccgtaccctacgtttacccaccgtaaccctagtaccccgtaggcccaccggttccgtacgtacgttacgttaccggtaagtttaacgttagttacgttacgttttaatttacgtaccgtcgtaatacgaagtttaacgttaacctttagttaccgttccgggttaccttcgttaccgtttaacccgggttagggtacccggggacgggttacggtacggttagacggtaactacgggaactacggttcgaccggtcgacncgttacngtttccgcttaccc

SEQ ID NO: 175665 - DNA, 885 bp, Homo sapiens
  misc_feature: GYAE6OF01B1G8X.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtcgtctaccgaggggaaacgacgcccaccctctcctgccgagggccagtcaggtagttagttaatacgcgtacttacgcctacggtaccagaccaagtactaccgtcggccacggcctccccgaggtcctccctacacttctaggtcggtcgactactaccgtacccgacgggtccctaagttcgggtacctaccccgacgtacccgtaacgggtttccacgggttcggaccggtagggttccggggtacgggtacgggggtaacaagggttaccgtttacccgacccttttacccgtaccctaaacccgttaacgttacccgaacggacccgtaaccggtcccgttaccggtacccgtaacggtttaccggtttaaggtaaacgggttttacgtttttaccgggttaaccgtttaaacggttttttaccgttttaaccgtttacgttacgttacggttaaccgttaacgtttaaacgtttaaacgtttaaccgtttaccgggttttccgttaccggttacccgtttaaccggtttacccggggttttaccgggggtaacccggggggggttaaccggttacggggtaaccgggtaaacgggtaaccgttaaaccgggtaaaaccggtacccggttaggttaccgggtaccgtaacggtacccggttaaccgtacgtttcccgttacggttttacccc

SEQ ID NO: 175666 - DNA, 736 bp, Homo sapiens
  misc_feature: GYAE6OF01BA7F7.12.23.C01.1.454.CMB.1.raw
  modified_base (203)..(203): a, c, t, g, unknown or other
  misc_feature (203)..(203): n is a, c, g, or t
  modified_base (476)..(476): a, c, t, g, unknown or other
  misc_feature (476)..(476): n is a, c, g, or t
tcagatacgacgtacacgaccggtgctcgatttagtacacgtgattagggattgggggaggaactgctcagttaggaccagacggaaccatggaagccccagcgcagcttctcttcctcctgctactctggctcccagataccactggagaaatagtgatgaagcagtctccagccacctgtctgtcgtctccgaggggaaancgcccaccctctcctgcgacgggccagtcaggtagttagttaataggccgtaacgttaacgtccgtacgggtaaccaggaccaaggtacttacccgtcggacccgaacggtccctaccccggaggtcccttaccctccacttaccgtaacggttcgggttacacctacgttaccgtaacccgcggggtacccacgttaggtaccttcccgacggccgttaacgggttcaacgggttcggcgtcgggtcgggtcgtcgggactaggtcgttacnccgtactcaaccactcgacgcacgtcctacgcgtagtctaggaactttacgtttcgacttaaggttttacttacgttagtacgtagtacgttaacgtttaagtaacgtttacgttcgggtttacccagttccgttacgggttaccgggttcgggggtacccgggggtaaacgtggggttaaggaacggttaacgaaccgttaaacggtcgggttacgtacggtcgtaacgtccgtaacctcggtttccgttcgtttcccg

SEQ ID NO: 175667 - DNA, 770 bp, Homo sapiens
  misc_feature: GYAE6OF01DY2G7.12.23.C01.1.454.CMB.1.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
  modified_base (399)..(399): a, c, t, g, unknown or other
  misc_feature (399)..(399): n is a, c, g, or t
tcagatacgacgtacacgaccggtgctcgatttagtacacgtgattagggattggggagaactgctcagttagacccagacggaaccatggaacgccccagcgcagcttctcttcctcctgctactctggcctcccagactaccacgtggagaaatagtgatgaacgcagtcctaccacgccctaccgtgttcctgtcgtcctacggaaggggaaacncgcccctacctctccgngacgacgggcctaggtcaagtacgttagttaaacncggctaacgttacgccgttacgaccacgtcaacgtacgtaccgnggacctacggtcctccgaggtccttccgctaatcgtgtcggtcactagtaccgaccgcggtacctaacggttcgtacctacccgngtcgtacggtcaggtcgcgttagggtcgggtactacgggactagtaccgttaccgacttccgactaccgtacgttcgacgaccggtagccgtacgtacgtaacgttacggtaacggttaagtttcgttttacggtaacgttttaaaggtttaccttacgttacggtacctaggtaaccgttaagtttaaacttaaacgtttaaccggttgtttacccgttacgttacgttaacccggtttacggggtacccgggtaaccgggggtacttaaaggggtacggtaaacgtaaccggtaaaccgtaacgggttacgttaccgggttagaacccgttacggtaaaccttacctttacccggtgtttccgtacccg

SEQ ID NO: 175668 - DNA, 822 bp, Homo sapiens
  misc_feature: GYAE6OF01DPK74.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggcctcccagataccacgtggaagaaatagtgatgaagcagtctccagcccaccctgtctgtcgtctaccgaaggggaaacgacgcccaccctctcctgcgagggccagtcaggagttagtaatacgcgtacttagccttaggtaaccaggcaacgtactaccgtcggacccgtaggccctacccgaggtcctcctctacttactagtgggtcacctacgtaccgtaaccggacgggtaccctacgttacggtacctccccgaagtcccgtaaggttaccgaggtcggacgtagggtcgggtcgtaggggactacggttacgtcctactaccgtaccaacctacgtacgaacgccgtaccggtccgttagaccgttaagtttcgtaaaaggttaaacgtttgtttttacgggaacctttttaaaggttttttaataccggtttgtaacaacgggtaactttaaagtttaaactttaaacggtttaccgtttacgggttttccctacggttccccttaacgggtttacccggggtttaccgggggggggaaaccccggggttaaagaaacgggggggtttaataaaccgggtaaaaccttaaccgggtaaaaaaacccggttgggtttaccgggtagggttaaccccttacggaaaccccttaaccgtttaccgtttcgtttgttaacccccg

SEQ ID NO: 175669 - DNA, 862 bp, Homo sapiens
  misc_feature: GYAE6OF01CX2VF.12.23.C01.1.454.CMB.1.raw
  modified_base (223)..(223): a, c, t, g, unknown or other
  misc_feature (223)..(223): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
tcagatacgacgtacacgaccggtgctcgatttagtacacgtgattagggattggggggaggaactgctcagttaggacccagacggaaccatggaacgccccagcgcagcttcctcttcctctgctactctggcctcccagactaccacgtaggaagtaaatagtgataggaagcacgtcaccacgccctacctgtctgtcgtaccgtacggaaggggaacncgccctacctcgtcgcggcgacggctagtcgtaaggtagttaagtaagtacggtaccgtacgttacgtcgtacggtaaccaggaccaagtactaccggtcggaccgaccggtcccgtaccgacgtcctcctanactacgtgtgtccnctacgtccgacggacggtctacggtacgaccttaccgacggttacggtacggttacgagggtccgggtaggttacggggtccggggtaggtcggtaacgtacggttacgttaccaaccgttcacccgtaacgacgtacgaacgtcgtaccgtcgtacgacggttacgtaacggtaagtttacgtttactttacggtttaacgttttaacgttttactaacggttcgttaaacgttaacggttaaccgttaaacggtttaaacgtttaaacccggtttccggttttaacccggttcccgtagggtttaaccccgtttacccgggggttaccgggggttaaccgggggggtaacccggggttaaacggtacgggggtttaaaccggaaccgtttaaaaccggtaacccgggttaaacggttccgggttacggtaacccggtaccgtaccggtaacccgtaacgtttcggttaacccgtttcccgttaaccccgg

SEQ ID NO: 175670 - DNA, 931 bp, Homo sapiens
  misc_feature: GYAE6OF01BJIAN.12.23.C01.1.454.CMB.1.raw
  modified_base (232)..(232): a, c, t, g, unknown or other
  misc_feature (232)..(232): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
tcagatacgacgtacacgaccggtgctcgatttagtacacgtgattagggattgggggaggaactgctcagttaggacccagacggaaccatggaagcccagcgcagtcttctcttcctctgctactctggcctccagggtcgaccgaccggtaagtaacttcgtgttacgacacgtacgtcctccacgtccctaccgttgttcctttcgtccgtaccggaaggggtaaacnccgacctaccttctacctagacggtacggcagtcgtaggtacgttacttacgacctaccttacgtacgtaccgtaacggtaaccaacggtaaccgtaaccgtggacccgtaacggtaccctccggaacgtctacctntaacgtactacgtagactcgacgtaacgtaccggaaacggcctacggacggtacctaccnccggtacggaccgtacgttacggacgggttcggaacggttacgggtcgggttaccggtacgggggtaccttaaacgtaccgtttacccgtaacgttcccgtaaaccgtaccgtaacgttacgaaacccgggtaccgttaacccggtaaacgggttacggtaccgttaaacccgggtaagttaaccgtttacggtttacgtaacgtttaacgttttaacgtaacgttaccgtacctacgggtaacgtaacgggttaccgtaaccgtaccgggttaaccgttccggggttaacccggttttaaccggtttccccggtttaacccgggttacggggtaaccccgggtaagggttaacccggttaaaggttccccgggtaaagggttaaaccctaacccgggttaaaccgtaaaccggggtgttacccgggtaaccgtaacgggtcctaaaccgggaccctttcggtttaccgtaaccgtcccgtttaggttaccccttaccccgg

SEQ ID NO: 175671 - DNA, 743 bp, Homo sapiens
  misc_feature: GYAE6OF01CILGG.12.23.C01.1.454.CMB.1.raw
  modified_base (496)..(496): a, c, t, g, unknown or other
  misc_feature (496)..(496): n is a, c, g, or t
tcagatacgacgtacacgaccggtgctcgattttagtacacgtgattagggattggggggaggaactgctcagttaggacccagacggaaccatggaagccccagcgcagcttctcttcctcctgctactctggcctcccagactaccactggaagaaattagtgatagaagcagtcctccacgcccaccctgtctgtcgtccgtaccggaaggggaaacgacgcccaccctctccgtggccgagggccagtcgaggtaggttagtaatacgacgtacttacgccgtacggtacagacagactaccgtcggaccgtacggtcctacccgacggtccttcctactacttcgtagtacggtctacctacgttaccgtaccgtaccgggtacctacggttaccggttacctacccgacggtaccgtacggttacgaggtcggtacgtacggggttgggtacggtagggactaggtacgttccacttccgacaccgtacncgacgtaccgacgtcctcgactacgtacgtagtaagttctttagacgttgttagtttatttacgtacgttacacggtaacgtaggttacgtacggtaccgggtacgttacccgttaaccgtttacgttaccgggtttaccgggaccgggtaacgggtacgttaaccgggtagggtaccggtaagtaacggttaacggaaccgttacggtcggtaccggtacgtacgtaccctaaccgtcgttacccg

SEQ ID NO: 175672 - DNA, 758 bp, Homo sapiens
  misc_feature: GYAE6OF01DWF6Q.12.23.C01.1.454.CMB.1.raw
  modified_base (109)..(109): a, c, t, g, unknown or other
  misc_feature (109)..(109): n is a, c, g, or t
tcagatacgacgtacacgaccggtgctcgatttagtacacgtgattagggattggggggaggaactgctcagttacggacccagacggaaccatggaaacgccccagcncagcttcctccttcctcctgcctacttcgtggcctcccagactaccactaggaagaaatgtgatgaaagctagtctaccgagtcccacctgtctgtcgtcctacggaaggggaaacacgaccctacctcgtcctggaccgacggggccaagtcgaagtagttacgtaatcggctaacgttacgccgttacggaacctagcgtaacggtactacccggttcggacccgacgggtccctacccggtacgtccgtacccctattaacgtacgttagttcggtcaccgtaactccggtaaccggacggtacctacggttacgttacccacccacggtcgtcggttacacggtcgacggtacgggtcggttaccggaggtaacctaggtactacctccgttaaccaccgtaagtacctcggacgtaccgtaacggccgtagtaccgtacgtacgtaagttaaggttctttacgttagtttaaactttgttacgtcgtaacgtagtacttaagttaacgttacttacggttccgttacggtctaccgttcggtacgggtcggggtaaccgggtacgacgggtaggtaaacgtcggtaaaccgtacggtaacggttcgtacggtacctacgtaccttacgtcttacgtcgttaacc

SEQ ID NO: 175673 - DNA, 813 bp, Homo sapiens
  misc_feature: GYAE6OF01EGOJM.12.23.C01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
tcagatacgacgtacacgaccggtgctcgatttagtacacgtgattagggattgggggaggaactgctcagttacggacccagaccggaaccatggaacgccccagcgcagtcttctcttcctcctgctactctggctaccagactaccactaggaagtaaatagtgaactgaagcacgtctcacgcctaccgtgtcctggtctacacgaagggaacncgtccaccttncctagccaggctaggcagtactagtacngactattacggccttagaccgtancgagactacgcgacnggtaccacgagctacntaacttcgaaggtgtacgactacttacgaaccggcggtaaccncgttcgaactacccggagtaccgtagtaccgtagacgggacttaggggtnttaccgggngggtaaccaggttacgttacnccttacgaccgaactacgacgtacgcgaacgttcgaccggtacgtacgtaccgtaagtaacggttacgtacgggttaacttaacccgttaaacgtagttaaccccgtttttaaagaaaacggaaagttttaacccggaatttaaccccgggttaccccgttaaccccgggttaacgtaccccggtttaaacggaccccggtaaaacgggttaacgtaacccggggtaaccgtttacggtaaaaacccgggttaaaccgttaaacggggtttaaccccggtaaacggttaccggggttttaccgaacgtttacccggtaacccgttttaaaccgttaaccccgggttttcggttaaaaccttccccgttttaaccccgg

SEQ ID NO: 175674 - DNA, 896 bp, Homo sapiens
  misc_feature: GYAE6OF01DK7SI.12.23.C01.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagcccagcgcagcttctcttcctcctgctactctggctcccagactaccaccgganaaattgtgttgactcagtctccagccacctgttctttgtctcgaaggggaanagccaccctctctgacgcggccagtcagtagttagtaacagtaactacgttacgcgttaggtaccagcgagacgtaccgtggccgacggcctcccgaggtcctcctcattctatacgtaattactagttaggaaacgggacgggtacccacggtacgggtacacttaccgtacggacggaccgtaagtacgttaaccgtaaggtcgggtaaccgttaggggttacgggttacccggtaggggtaaacccgtaacggttaaccctttacgtacccttaccctaaccccgttaccccgttaacccaaccggtacccggttaaccccgtttaacgggaacccggttacccggtttaaacgggttaaaggttttttaacggtttttaaacgggtttaaaacttttttacgttttaaaccgttccggttaaacgtaaaaccggttacggtttaaccgttaaaccggtacccttaaaccgggtttcccggtaccccgttttaccccggtttacccggggttttaaccggggacccggggtaaacgggggttaacccgtaaagggggtcggtaaacggtaccgttaacggaaaccggtaaccggtaacggttcgggtaccggttaaccgttcggaacccgtaaccgttacgtttcgttaccgttcccgttttaccctcccgtttacccccgtttacccgg

SEQ ID NO: 175675 - DNA, 918 bp, Homo sapiens
  misc_feature: GYAE6OF01C04KW.12.23.C01.1.454.CMB.1.raw
  modified_base (179)..(179): a, c, t, g, unknown or other
  misc_feature (179)..(179): n is a, c, g, or t
  modified_base (412)..(412): a, c, t, g, unknown or other
  misc_feature (412)..(412): n is a, c, g, or t
tcagatacgacgtacacgaccggtgctcgatttagtacacgtgattagggattgggggaggaactgctcagttaggacccagacggaaccatggaacgccccagcgcagtcttcctcttcctcctgctactcgtggcctcccagtactaccacgtggaagaaataggtgaatggaaacncctaggtacctaccgacgccctacccttggtccttagttcgtacctaccgggaagggggtaaacgccgacccctacccttccgttccgtaggccggtaacgggccctagggtaccaaggttagtttaaccgttaaagtacggaccgttaacgttaccggtcccggttacgggaaccagggtaccaacggttaaccgtacccggtacggacccgtacgggaccccttacccggngttacccctacccctagtaattaccggtttaggtcgggtacctaccttaacccgtaaccccggggttaccgaaccggggttaccctaagggttttacccggaacccttaccccgagggttacccggttaagttcgacgggttcggtaacggtacgggtttcggggacggtttaaccgggacttaacggttcctaccggttacctaccggtaacccttaaccgaagttccgaccgaccgttaccggtaaccgtcggtaacgttacgttaagtaagggtttaacgtttcggtttacgtacgtttaacgttttacacggttataccgtacgttaagttaacgttaaacttaacgtttaaccggtttcgttaccgttacgtccgtttaccgggttacggggttacggggaccgggtacggtaaggtacggtacgtaaacgtaacgttaaacggtcggttaccgtacggttacctaacggacccttataaccggttcgtttaccttaaccg

SEQ ID NO: 175676 - DNA, 888 bp, Homo sapiens
  misc_feature: GYAE6OF01A5J9Y.12.23.C01.1.454.CMB.1.raw
  modified_base (232)..(232): a, c, t, g, unknown or other
  misc_feature (232)..(232): n is a, c, g, or t
tcagatacgacgtacacgaccggtgctcgatttagtacacgtgattagggattgggggagaactgctacagttacggacccagacggaaccatggaagccccagcgcagtcttctcttcctcctgctactctggccttccaggataccacgtggaagaatagtgatggaagctagtcctaccacggtccctacccgttgtccgttggtcgttaccgtacggaaggggaaacnccgcccgtacctcgtccgtacggcgacgggtctagtcgaaggtacgttaagttacgacggtctacgtttaccggccgttagaccgagtccgaagttaccgtaccggtggaaccgtacggtcctaaccgacggttcctccgtacgtaagttaccgtttaggtcgggttaacaccttaccggtaccggttaccggacgggtaccctagggttaacgtaccgtaccgtaaacggtccggttaaacggttcgtaagggtccggtaagggtttacgggttacggggttacggtaaacggggtaaccttaaggtacctttacccgggtaaactcccctttaaacggacccctacgttaaccggaccgtaccggtaaaccggtccgttaaacggggtacgttaaacccggttaggtttaaacccgggtttaaagttacccgggtttttaagtaacccggtttttaacggttaatttacgggtaccttaacggtaaccgttaagttaaaccggtttaacttaaaccgttcggttaccgttaccgttacgttacccggtaacgttaccgggtacggggaaccggttaaggtaggtaccgtaacgtacgtaaccgtaagggtctacggtcgtacgtacgacttacgttcggtcctttggtaacccg

SEQ ID NO: 175677 - DNA, 921 bp, Homo sapiens
  misc_feature: GYAE6OF01BCQZW.12.23.C01.1.454.CMB.1.raw
  modified_base (188)..(188): a, c, t, g, unknown or other
  misc_feature (188)..(188): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (915)..(915): a, c, t, g, unknown or other
  misc_feature (915)..(915): n is a, c, g, or t
tcagatacgacgtacacgaccggtgctcgatttagtacacgtgattagggattgggggaggaactgctcagttaggacccagacggaccatggaagccccagcgcagtcttctcttcctcctgctactcgtcggcctaccagactaccacgtaggaagaaactaggtagataggaacacgacgttccnccgacgtaccctacccgttggtccttggtccgttacgtaccgggaagggggaaactccgacccctacccttcgttcccgtcggaccggaacggggtccctaaggtacgaagggtacggtttaggttaaacgtaggtaccgttaactttacgggaccggttaacggacccgaggtacgtaagtacccttaccgggccggaccaccggtccctacccgacgggtcccctaccttacnccgttaacggttccggtaacgngtaacccgtacgtacccggaccgggtcctaacgtcggtacgtacccgaccgcggttaacggttcgtcggggtaacggtcgtacggggtcggtacgggttaccgacggtaacgtttcgactttaccctacgtacccgtaacccgtacgtaccgtacgtacccggtacgtaacccgtcggtacgtaaccggtttaggtaaatttaaccggggttaacttttacggtaacgttttaaccgttttacgggttaaccttggttacgtaacggttaactaaaaccggtttgtttaaacccggttttaaccgttcggtttaaccccgttggttttaccggtaccggtttacccgggggtttaacggggacccggggggttaagggtaaaacccttggggaaacccgttaaacgaaccggttaagggtaccggtcggtagttaaccggcgtaaccgtagttaccgtctttaaccggtnttaccc

SEQ ID NO: 175678 - DNA, 497 bp, Homo sapiens
  misc_feature: GYAE6OF02GLZ4R.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagtattttgctagtttattactgtcagcagtataataactgttcctgctctacgttcggcgggggaccaggtggagatacaacgactgtggctgcaccatctgtc

SEQ ID NO: 175679 - DNA, 130 bp, Homo sapiens; identical to SEQ ID NO: 175556
  misc_feature: GYAE6OF02I67CE.12.23.C01.1.454.CMB.1.raw
  modified_base (130)..(130): a, c, t, g, unknown or other
  misc_feature (130)..(130): n is a, c, g, or t

SEQ ID NO: 175680 - DNA, 147 bp, Homo sapiens
  misc_feature: GYAE6OF02IOW4G.12.23.C01.1.454.CMB.1.raw
  modified_base (109)..(109): a, c, t, g, unknown or other
  misc_feature (109)..(109): n is a, c, g, or t
  modified_base (130)..(147): a, c, t, g, unknown or other
  misc_feature (130)..(147): n is a, c, g, or t
tcagatacgacgtacacgaccggtgctcgatttagtacacgtgattagggattgggcacagcggccctgggctgcctggtcaaggactacttcctacgtcgtatctgancgggctggcaaggcgcatagnnnnnnnnnnnnnnnnnn

SEQ ID NO: 175681 - DNA, 151 bp, Homo sapiens
  misc_feature: GYAE6OF02GK3ZL.12.23.C01.1.454.CMB.1.raw
  modified_base (130)..(151): a, c, t, g, unknown or other
  misc_feature (130)..(151): n is a, c, g, or t
tcagatacgacgtacacgaccggtgctcgatttagtacacgtgattagggattgggcacagcggccctgggctgcctggtcaaggactacttcctacgtcgtatctgagcgggctggcaaggcgcatagnnnnnnnnnnnnnnnnnnnnnn

SEQ ID NO: 175682 - DNA, 592 bp, Homo sapiens
  misc_feature: GYAE6OF02HVRTR.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggcctcctcatctatggtgcatctaccgagggcccatggtactcccagccaggttcagtggcaggtggtctgggacaggtgttcacttctccacctatccagcagcctgcagtctagtaagtattttgacttagttttattactgttacagtactagttaattaacttaacgtcggttcctcgtcttccgttacggtttccggggtaccggggggtaacctaggggttacggtacggtaacgtacgtaaaaccggtacgttacggtacggtaccgttacggacctaacccgtagttccgttacgttacc

SEQ ID NO: 175683 - DNA, 546 bp, Homo sapiens
  misc_feature: GYAE6OF02GKIA1.12.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangcccaccctctcctgcagggccagtcagagtgttaangcgtacttagcctggtaccagcagatacctggccaggctcccaggctcctnatctatggtncatcctaccgagggccacgtggtactcccgagccaggttcagtggcaggtggtctgggacagtagttcactcncaccatcagcacgcctgctagtctagtaagtatttgacttagtagttattattgtactagtcgtagtagttggtagccgtacgtaccgttacgtacgtttcggaccgtacgggtacaggtcgtaggagtagtaacgaacgtacgtacggtcggaccgtgacctacgtattcg

SEQ ID NO: 175684 - DNA, 522 bp, Homo sapiens
  misc_feature: GYAE6OF02HCHQ7.12.23.C01.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccgagggccactggtatcccagccaggttcagtggcagtgggtctgggacagagttcactctcacntcancagcctgcagtctgaagtatttgctagtttattactgtcagctagtataatactgttcctgtctcgtacgttcgggaccgggggacctagggtggagtaacgacgtaaacgtaacgtggtggctacggctaccgattcgtgttcc

SEQ ID NO: 175685 - DNA, 525 bp, Homo sapiens
  misc_feature: GYAE6OF02F3WEG.12.23.C01.1.454.CMB.1.raw
  modified_base (202)..(202): a, c, t, g, unknown or other
  misc_feature (202)..(202): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaanagccaccctctcctgcagggccagtcagagtgttaatagcgacttagcctggtaccagcagatacctggccaggctcccaggctcctcatctatggtgcatctaccagggccactggtatcccagccaggttcagtgcagtggtctgggacagagttcactctcaccatcagcagcctgcagtctgaagtattttgcttagtttattactgtcagtcagtataattaacgtggttcctgtctctacgtttcgggcgggggtacctagggtggagtactacgaaacggtaacgtggtacggctcggaccaccgatccgtgttcc

SEQ ID NO: 175686 - DNA, 537 bp, Homo sapiens
  misc_feature: GYAE6OF02HWIC5.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaattgtgttgacgcagtctccaggcaccctgtctttatctccaggggaaanagccaccctctcctgcagggccagtgagaatgttaacaacaggtatctggcctggtaccagcaagaacctggccaggctcccaggcctcctcatgtacgttactccagcagggccactggcatcccagacaggttcactggcaggtgggtctgggacagtacttcactcacaccatccaccagacgtggacgcctagaagtatttgactagtgttattattgtctagctagtagtggtagcgcaccgtactacgtttggccgtagggtaccgagcgtaggagagtagaaacgaacgtggtacgtcgtacgcgacatccgtgtcttcacttcccg

SEQ ID NO: 175687 - DNA, 656 bp, Homo sapiens
  misc_feature: GYAE6OF02JLIX0.12.23.C01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagatacgacgtacacgaccggtgctcgatttagtacacgtgattagggattgggggagggaacgtgctcagttaggacccagacggaaccatggaagccccagcgcagcttctcttcctcctgctactctggctcccagataccactggagaaatagtgatgaagcagtctccagccaccctgtctgtgtctccaggggaaangccaccctncctgcagggccagtcagagtgttaangcgacttaggcctggtaccagcagatacctggccaggctcccaggctcctcatctatggtgccatcctaccgaggggcccacgttcgggtatcccccaggcctagggtttccaggttcggccgtaggtcggggttcctgggggaaccaggaggtttccaaccgttctccgaacccattccgagtccaacggtccctggctacggtcttacggaaagtacgtttttcgacgttagtttttacttaccgttgttctagccgttaagttacttaaattaaccgtttgggtttacccttgtccttacgtaccgtttcggggaccgggggtaacctagggttacgggacgttaacgtaaccgaaacggtaaccgttggtacggtaccgttacgggacctacgtacgttcgttagttacccg

SEQ ID NO: 175688 - DNA, 509 bp, Homo sapiens
  misc_feature: GYAE6OF02IW9IF.12.23.C01.1.454.CMB.1.raw
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
  modified_base (492)..(492): a, c, t, g, unknown or other
  misc_feature (492)..(492): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggcctcccaggcctcctcatctatggtgcatctaccagggccacgtggtactcccagccaggttcaggtggcaggtgggtctgggacaggagttcactctcaccntcagcagcctgcagtctgaagtatttgctagtttattactgtcagctagtataatacgtgttcctgtctctacgttcgggcggggtaccaggtggagtatacaacgacgtgngtcgtgcacatcgtgtc

SEQ ID NO: 175689 - DNA, 522 bp, Homo sapiens
  misc_feature: GYAE6OF02ILFMS.12.23.C01.1.454.CMB.1.raw
  modified_base (204)..(204): a, c, t, g, unknown or other
  misc_feature (204)..(204): n is a, c, g, or t
  modified_base (438)..(438): a, c, t, g, unknown or other
  misc_feature (438)..(438): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaatagcgacttagcctggtaccagcagactacctggccaggcctcccgaggcctcctcatctatggtgcatctaccgagggccatcggtactcccagccgtaggttcagtggctaggtgggtctggggactaggtagtttcactctacacctatcagcacgcctgcagtcagaagtatttgctagttttatacgtgtcagntagtataattacgtgttcctgtctctacgttcgggcggggacagggtgagaatacaacgtacgtgtggctgaccactatctgtc

SEQ ID NO: 175690 - DNA, 528 bp, Homo sapiens
  misc_feature: GYAE6OF02IEO7F.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccactggactccagccaggttcagtggcagtgggtctgggacagagttcactctcaccatcagcagcctgctagtctgaagtattttgcttagttttattacttgtcagtactagtaataattaacgtggttacctgtccttcgacgtttcgggccgggggtacagggtaggagaagtacgaaacgaacgttgtggctcgccacacttctgttcc

SEQ ID NO: 175691 - DNA, 514 bp, Homo sapiens
  misc_feature: GYAE6OF02HE8HM.12.23.C01.1.454.CMB.1.raw
  modified_base (203)..(203): a, c, t, g, unknown or other
  misc_feature (203)..(203): n is a, c, g, or t
  modified_base (375)..(375): a, c, t, g, unknown or other
  misc_feature (375)..(375): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccactggtatcccagccaggttcagtggcaggtgggtctgggacaggagttcactctcaccntcagcagcctgcagtctagaagtattttgcttagtttattactgtcagctagtataataacgtgttcctgtctcgtacgtttcgggcgggggtaccagggtggagactacgaacgactggtggctgcaccgatcgtgtc

SEQ ID NO: 175692 - DNA, 531 bp, Homo sapiens
  misc_feature: GYAE6OF02IAGVC.12.23.C01.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaaatagcgacttagcctggtaccagcagataccgtggccaggctcccgaggctcctcatctatggtncatctaccgngggcctagtggtactcccagccaggttcagtggcaggtggtctgggacagngttcactctacacctatcagcacgcctgcctagtctagtaagtnttttgacttagttttattaactgtcagtactagttaataagttactgttcctgtctcgtacgttcgggcggggtactaggtggagactacgaaacgacgttgngtctcgctacnttcctgtcc

SEQ ID NO: 175693 - DNA, 561 bp, Homo sapiens
  misc_feature: GYAE6OF02GKP99.12.23.C01.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggcctcccaggctcctcatctatggtncatctaccgagggccactggtactcccagccaggttcagtggcaggtgggtctgggacagagttcactctcaccatcagcagcctgcagtctagaagtattttgacttagtttatttactcgttctagtctaagttaattaattaacgttggtttccttgtccttcgtacgtttcggggaccgggggtaccgtagggtacggtaggtaacgtacgaaacggtacgttagtggtcgtcgacctaccgtacttcgtgttcc

SEQ ID NO: 175694 - DNA, 581 bp, Homo sapiens
  misc_feature: GYAE6OF02J1J7Q.12.23.C01.1.454.CMB.1.raw
  modified_base (239)..(239): a, c, t, g, unknown or other
  misc_feature (239)..(239): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
tcagatacgacgtacacgaccggtgctcgatttagtacacgtgattagggattgggggagggaactgctcagttaggacccagacggaaccatggaagccccagcgcagcttctcttcctcctgctactctggctcccagataccactggagaaatagtgatgaagcagtctccagccaccctgtctgtgtctccaggggaaagccaccctctcctgcagggccagtcagagttgtaanagcgacttagcctggtaccagcagatacctggccaggctcccaggctcctcatctatggtcgcatcctaccagggcccagttcggtaatccccgagcctaggttccagtcggcctagtgggtccnggggtacngtagtcactctcaccatcagcagcctagcagtctgagtatttgctagtttactattgtctacgtntaagttataacttaacgtcggtttcccgtagtccttacgttaccggtttacgggccgggggtaacctaggtacgggtaggaacgttaccgaaacggtacgttacggtggccgttacgaccgtaccgtacgttccgtagtttccc

SEQ ID NO: 175695 - DNA, 553 bp, Homo sapiens
  misc_feature: GYAE6OF02F13PI.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccgagggccacgtggtactccgagccaggttcagtggctaggtggtctgggacaggagttcactctcaccatcagcagcctgcagtctagaagtatttgcttagtttacttactgtcagtacaagttataattacgttggttcctgtccttacgtacgtttccggggacgggggtacctagggtggaaggtaacgtacgaaaccggtaacgttaggtaggcgtcggaccaccgtacttcgtcttcg

SEQ ID NO: 175696 - DNA, 544 bp, Homo sapiens
  misc_feature: GYAE6OF02JIJB3.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccactggtactcccagccaggttcagtggcaggtgggtctgggacagtagttcactctcaccatcagcagctgcagtctagaagtatttgctagtttattactgtacagctagttaataattaacgtgttcctcgtcttcgtacgtttccggggacgggggacctagggtggagtaacgtacgaaacggtaacgttggtggtactggaccaaccgtacgttacgtgttacc

SEQ ID NO: 175697 - DNA, 552 bp, Homo sapiens
  misc_feature: GYAE6OF02GGBYF.12.23.C01.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (410)..(410): a, c, t, g, unknown or other
  misc_feature (410)..(410): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagccaccctctcctgcagggccagtcagagtgttaatagcgacttagcctggtaccagcagatacctggccaggcctcccaggcctcctcatctagtggtncatcctaccgagggccacgtggtactcccagccaggttcaggtgcaggtggtctgggacngtagttcactctacaccatcagcacgccctgctagtctagaagtnttttgcttagtttattacgtgtcagtctagtaataattacgtcgttctgtctcgtaccgttcggggaccggggtactagggtaggagtaacgtacgaaacggtacgttggtacggactaggaccaccgtattcgtacgttcc

SEQ ID NO: 175698 - DNA, 130 bp, Homo sapiens; identical to SEQ ID NO: 175556
  misc_feature: GYAE6OF02H44KK.12.23.C01.1.454.CMB.1.raw
  modified_base (130)..(130): a, c, t, g, unknown or other
  misc_feature (130)..(130): n is a, c, g, or t

SEQ ID NO: 175699 - DNA, 585 bp, Homo sapiens
  misc_feature: GYAE6OF02G2L9U.12.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagccaccctctcctgcagggccagtcagagtgttaatagcgacttagcctggtaccagcagatacctggccaggctcccaggctcctcatctatggtncatctaccgagggccactggtactcccgagcctaggttcagtggctaggtcggtctgggacaggtacgttcacttcgtccacctagtccagtccacgtccctggacctagtcgtaggaaagtgtttttgacttaagttttacttacgttgtactaggtctaagttattaagttaacgttcggtttcctagtccttacgtacgtttcggggacgggggtaacctagggtcggtaagacgtaacgaaacggtacgtggtggcgtcgacctacgtattccgtgtcc

SEQ ID NO: 175700 - DNA, 562 bp, Homo sapiens
  misc_feature: GYAE6OF02HAXCN.12.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtncatctaccgagggccacgtggtactcccagccctagggttccaggtcggctaggtcgggtctgggacaggtagttcactctcacatcagcacgcctgcagtctagaagtattttgcttagttttacttacgtgtcagtctagttaataacttacgttcggttcctgtaccttcgtacgtttcggggacgggggtaccgtagggtggaggtaacgtacgaaacggtaacgtggtacggcgtgacctacctagttcctgttcc

SEQ ID NO: 175701 - DNA, 555 bp, Homo sapiens
  misc_feature: GYAE6OF02H3X8Z.12.23.C01.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaanagccaccctctcctgcagggccagtcagagtgttaaangcgacttagcctggtaccagcagatacctggccaggctcccgaggcctcctcatctagtggtgcattcctaccgagggcccagtggtactccccgagccaggttcaggtgcaggtgggtctgggacagtagttcactctcaccatccagcagcctgcagtctagaatnttttgacttagttttattacttgtnagtactaagttataaattacgtgttcctgtcttcgtacggtttcgggcgggggtaccgtagggtggtagaacgtaccgaaaggtaactggtggtactacgcctacgacttcgtagttcc

SEQ ID NO: 175702 - DNA, 527 bp, Homo sapiens
  misc_feature: GYAE6OF02GKA4B.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatgcgacttagcctggtaccagcagatacctggccaggctcccaggctcctcatctatggtgcatcctaccagggccacgtggtactcccagccaggttcaggtggcaggtgggtctgggacaggagttcactctcaccatcagcagcctgcagtctagtaagtatttgcgtagttgttattattgtcagtcgtagtagtggtagcgtactaccgtactacgtttcggccgtacgggtccaaggtcgtggagtagtacggaacgtacgtgtcggcgtgactactagtcg

SEQ ID NO: 175703 - DNA, 503 bp, Homo sapiens
  misc_feature: GYAE6OF02I5YN3.12.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgccagggccagtcagagtgttaangcgacttagcctggtaccagcagatacctggccaggctcccaggctctcatctatggtgcatctaccagggccactggtactcccagccaggttcagtgcagtggtctgggacagagttcactctcacctatcagcagcctgcagtctagagtatttgctagtttattactgtcagcagtatatactgtctgctctacgttcggcggggtaccagggtgagattacgaacgtacgtgtaggctcgacgacacgttctagtccg

SEQ ID NO: 175704 - DNA, 526 bp, Homo sapiens
  misc_feature: GYAE6OF02I7C6C.12.23.C01.1.454.CMB.1.raw
  modified_base (203)..(203): a, c, t, g, unknown or other
  misc_feature (203)..(203): n is a, c, g, or t
tcagatacgacgtacacgaccggtgctcgatttagtacacgtgattagggattgggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctgggggcaggacttcactctcaccatcagcagcctagacgcctgaaagattttgctaagtttattactgttcagtcagcgtagcaactggccttcggttcacttttggccgaggggaccagctggagatacaaacgtactgtggctcgaccacgtctcgttcgtactctccttcccg

SEQ ID NO: 175705 - DNA, 612 bp, Homo sapiens
  misc_feature: GYAE6OF02ID3WL.12.23.C01.1.454.CMB.1.raw
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
  modified_base (457)..(457): a, c, t, g, unknown or other
  misc_feature (457)..(457): n is a, c, g, or t
  modified_base (583)..(583): a, c, t, g, unknown or other
  misc_feature (583)..(583): n is a, c, g, or t
tcagatacgacgtacacgaccggtgctcgatttagtacacgtgattagggattgggggaggaactgctcagttaggacccagacggaaccatggaagcccagcgcagcttctcttcctcctgctactctggctcccagataccactggagaaatagtgatgaagcagtctccagccacctgtctgtgtctccgaggggaaacgcgccctaccctctccgtgaccgagggccaacggtcaggagtgttaaagagcgtacttagcctagggtaccaggcagattaccnggccaggctcccgaggctccnatctatggtcncatcctacgacgggccatggtactccgagcctaggttcaagtcggacaggtgggtcctagggacaagtgttacacttcacaccatcagcagctcgcagtctagtaagtattttcgacttagttttactacttgtactanacgtaagtaacttaaattaacgttcggtttaccctagtccttaaccgttcggttttacccggggaccggggggtaacctaaggggtacggtacgaaacggttacaaaacgggtatacggtggtacncggacctaaccgtacgttcgttattcccg

SEQ ID NO: 175706 - DNA, 512 bp, Homo sapiens
  misc_feature: GYAE6OF02HZN6J.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacaggagttcactctcaccatcagcagcctgcagtctagagtattttgctagtttattactgtcagctagtaataatactgttcctgtcttctacgtttcgggcggggtacctagggtggagatacgaaacgtaactgtggctgacctacattctgtc

SEQ ID NO: 175707 - DNA, 508 bp, Homo sapiens
  misc_feature: GYAE6OF02F3G4J.12.23.C01.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (506)..(506): a, c, t, g, unknown or other
  misc_feature (506)..(506): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctccccaggctcctnatctatggtgcatctaccgagggccactggtatcccagccaggttcagtggcagtgggtctgggacaggagttcactctcaccatcagcagcctgcagtctagaagtatttgctagtttattactgtcagcagtataatactgttctgctctacgtttcgggcgggggaccagggtggagtatacgaaacgtacgtggtggctgcaccatcgtntc

SEQ ID NO: 175708 - DNA, 645 bp, Homo sapiens
  misc_feature: GYAE6OF02JMMJX.12.23.C01.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaangccacctntcctgcagggccagtcagagtgttaanagcgacttagcctggtaccagcagtatacctggccacggcctcccaggcctcctcgactccttagtcggtcgactactccgtaacccagggccctacgtcggttaactccccgagccctaggttcaggtcggaccgtaggtcgggttactaggggactaaggtacgttcacgttctacacctataccaggctacgcccgttgacgtacgtcgtaggtaagttacgttttgacgttaagtttttacttaccgttgttaccgagtacgttaagttaataaacgttaacgttcggttaccttagtcttaccgtacggtttccggggacggggttaccgtagggtcggtaacgtaacgtaacggaaacgtacgtcggttagcgttacgaccgtacgtacgttcgtacgttac

SEQ ID NO: 175709 - DNA, 657 bp, Homo sapiens
  misc_feature: GYAE6OF02JAE5E.12.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacccagtctgtgtctccaggggaaanagccaacctntcctgcagggccagtcagngtcttagcacctacttagcctggtaccaacagaaacctggccaggctcccaggctcctcatctatgatgcatccaaaaggccacgtggcatcccagccgaggttcagtggcagtgggtctggggcagcttcgactctcacctatccagcaacgccgtacgtagccgtagaagtactttacgtacttaagtttacgtttaacttacggttactacgtacgtaacgtcggttaacgtaccgtaacgttacgggtacccgttaccgggtttacccgttaaccgttttttacgggacccgtaacgggggtaacccgtaaacgggttccgttacggggtaacggtaacgttaaccgtaaaacggtaaccgttacggttacgggtaccggttacgtcccgtaaccgtaaccgttaccgtacgtttaacccg

SEQ ID NO: 175710 - DNA, 136 bp, Homo sapiens
  misc_feature: GYAE6OF02H3RO4.12.23.C01.1.454.CMB.1.raw
  modified_base (130)..(136): a, c, t, g, unknown or other
  misc_feature (130)..(136): n is a, c, g, or t
tcagatacgacgtacacgaccggtgctcgatttagtacacgtgattagggattgggcaaagcggccctgggctgcctggtcaaggactacttcctacgtcgtatctgagcgggctggcaaggcgcatagnnnnnnn

SEQ ID NO: 175711 - DNA, 564 bp, Homo sapiens
  misc_feature: GYAE6OF02I1JD1.12.23.C01.1.454.CMB.1.raw
  modified_base (202)..(202): a, c, t, g, unknown or other
  misc_feature (202)..(202): n is a, c, g, or t
  modified_base (354)..(354): a, c, t, g, unknown or other
  misc_feature (354)..(354): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaanagcaaccctctcctgcagggccagtcagagtgttaacagatacttagcctggtaccagcagagacctggccaggctccgaggctcctcatctatgataccattgaagagggccacgtggcatctcaggcagattacaatcggcagtcgggtntagggacagtactcactctccacccgtcacccagcctagactccgtagtaagtacgttttagaattttattacgttgtacaactacggtactagcaaccgtcgccctaccgtactttccgggacggtacggaccgtaagggtcggagtaactacggaaacgtaacctggtacgggctagtacccgacaccgttcgtcgtttctacgtacg

SEQ ID NO: 175712 - DNA, 530 bp, Homo sapiens
  misc_feature: GYAE6OF02GREMG.12.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatgcgacttagcctggtaccagcagatacctggccaggctcccaggcctcctcatctatggtncatcaccagggcccatggtatcccagccaggttcagtggcaggtgggtctggggacaggtacgttcacttctacacctatcagcagcctgctagtctgaagtatttgcttagtttattacttgtctagtctagtataattacgtggttctgtcttcgtacgtttgggcggggtacctagggtggagagtacgaaacgtacgtgtaggcgtcgaccgtacattcgtgttc

SEQ ID NO: 175713 - DNA, 580 bp, Homo sapiens
  misc_feature: GYAE6OF02HA3IU.12.23.C01.1.454.CMB.1.raw
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
  modified_base (425)..(425): a, c, t, g, unknown or other
  misc_feature (425)..(425): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaagagccaccctctcctgcagggccagtcagagtgttaatagcgtacttagcctggtaccagcagatacctggccaggcctccccgaggcctcctcatctatggtncatcctaccgngggccacgtggtactcccagcctaggttcaggtcggactaggtcggggtctgggactaggtacgttccactctaccgacctatcagcacgcctgcagtctagtattntttgacgttatttacttctcgtcagactaagttaattaacgttacgttcgttcctgtccttacgttacggttaccggggacgggtaacgtagggtggaacgtaacgtaacgtaaacgtacgttggacgtcgtacgactaccgtacttcgtgttcc

SEQ ID NO: 175714 - DNA, 550 bp, Homo sapiens
  misc_feature: GYAE6OF02HAV4A.12.23.C01.1.454.CMB.1.raw
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggcctcccgaggctcgtcatctatggtgcatccagcagggccacgtggcatcccagacaggttcaggtggcaggtgggtctgggacagcttcactcncacatcagtagactggagcctagaagtntttgcttagtttattacgtgtactagctagttaggtcggggtctcgacgtcgtacttcgtacgtttccggcccgtacgggtacctaaggtacgtaagtacgtaaccgaaacgtaacgtggtacggtacctaggcctacctagtccgtacg

SEQ ID NO: 175715 - DNA, 546 bp, Homo sapiens
  misc_feature: GYAE6OF02JHE1C.12.23.C01.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangcccaccctctcctgcagggccagtcagagtgttaatgcgacttagcctggtaccagcagatacctggccaggctcccaggtcctcctcatctatggtgcatctaccgagggccacgtggtactcccgagcctaggttcagtggcctaggtgggtcngggacagagttccacgtctcgactntcagcagcctgctagtctaggaatntttgcttagtttacttactgtcagtcagttataacttacgtcgttactgtcttcgtacgtttcgggacggggtacctagggtcgagtcgtaacgaacggtacgtggtcgcgtcgacctacgtagtccgtgttaccg

SEQ ID NO: 175716 - DNA, 510 bp, Homo sapiens
  misc_feature: GYAE6OF02JIY4F.12.23.C01.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccagggggaaanagccaccctctcctgcagggccagtcagagtgttaanagcgacttagcctggtaccagcagatacctggccaggctcccaggctcctcatctatggtgcatcctacagggccactggtatcccagccaggttcagtggcagtgggtctgggacagagttcactctcaccatcagcagcctgcagtctgaagtatttgcttagtttattactgtcagcagtataatactgttcctgtctctacgttcgggcggggtactaggtggacgagtacaaacggtacgtgtgctcgaccacctatctgttcc

SEQ ID NO: 175717 - DNA, 605 bp, Homo sapiens
  misc_feature: GYAE6OF02GITU3.12.23.C01.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (407)..(407): a, c, t, g, unknown or other
  misc_feature (407)..(407): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaanagccaccctctcctgcagggccagtcagagtgttaatgcgacttagcctggtaccagcagatacctggccaggcctcccaggctcctcatctatggtncatcctaccgagggcccacgtggtactccccagcctaggttcagtggcaggtgggtctgggacaggtacgtttccacttctaccaccctatccgagccagtccngcagtctagtaagttattttgacttagttttacttacgttgtacagtactaagttaactaaagttacgttcgttccgttagtcctttcgtaccggtttccgggggaccggggggtaacctaggggttcggaggtaacgtaacgtaaaccggtacgttaggtcggtactcggaccctacctacgttccgtagttacccg

SEQ ID NO: 175718 - DNA, 532 bp, Homo sapiens
  misc_feature: GYAE6OF02FPP3Q.12.23.C01.1.454.CMB.1.raw
  modified_base (203)..(203): a, c, t, g, unknown or other
  misc_feature (203)..(203): n is a, c, g, or t
  modified_base (414)..(414): a, c, t, g, unknown or other
  misc_feature (414)..(414): n is a, c, g, or t
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaatagcgacttagcctggtaccagcagatacctggccaggcctcccgaggctcctcatctagtggtgcatcctaccgagggcccacgtggtactcccgagcctaggttccggagtcggcaggtgggtctgggacagagttcactctcaccatcagcacgcctgcagtctagtaagttntttgacttagtttattacgtgtactagctagttactaattacgtgttcctgtctcgtacgttcgggacggggtactagggtgagactacgaaacgacgtgngctgaccacngtctntc

SEQ ID NO: 175719 - DNA, 558 bp, Homo sapiens
  misc_feature: GYAE6OF02IOOZL.12.23.C01.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagcccaccctctcctgcagggccagtcagagtgttaatagcgacttagcctggtaccagcagatacctggccaggcctcccaggctcctnatctatggtgcatctaccgagggccactggtactcccagccgtaggttcagtggctaggtgggtctgggacagtagttcactctcacctagtcagcacgcctgcagtctagtaagtattttgacttagtttattacttgtactagctaagtaataaagtacgttcgttctgtccttcgtacgtttcggggacggggacgtaggtacggagtaactaacgaacgtacgtgtacggtacgtcgaccgaccgtagtccgtagttacc

SEQ ID NO: 175720 - DNA, 582 bp, Homo sapiens
  misc_feature: GYAE6OF02HCWL4.12.23.C01.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (428)..(428): a, c, t, g, unknown or other
  misc_feature (428)..(428): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaangccaccctctcctgcagggccagtcagagtgttaanagcgacttagcctggtaccagcagactaccgtggccaggcctcccgaggcctcctctatctagtggtcgctatcctaccgagggcctacgtggtactcccaggtccctaggttcaggtggcgtaggtcgggtctgggacaggtagttccacttcacacctatcagcacgcctgcagtctagtaagtntttgcttagtttattacgtgtactagtctaagttaattaacttacgttcgttccgtagtccttacgtaccggtttcggggaccggggtacgtagggtggtaaggtactaacgaaacggtacgtggtacgtcgtcgaccacgtattcgtattccg

SEQ ID NO: 175721 - DNA, 837 bp, Homo sapiens
  misc_feature: GYAE6OF02J24GM.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctcggcctcccagactaccacgtggaagaatgtgatgaacgctacgtcctccacgtccctaccgttgtccgttggtacgtaccgaccggaaaggggaactccggccctacccgttcgtaccggtggaccgtaccggggtacctacggttacgacggttaacggtttacgttaacgaccggttaaccggttaccgttaccgggtacctacgggtaaccgaaggtaccgtaacggtccgttaacccggcggaccctaccgggtcctacccgaccgttcctacgtacttaacgtacggtacgtcggtactacctacggtacccggtacgaccgtaccgttacgtaccgtaccgccgtacgtacggtcggtacggcgtacggtacggtaggtccgggttacgaacgtactacgtacttacccgtcctaaccggaccttacgacgtaccgtaccggtaccgtacgtcgtacgtacgttacgtagttacgttacgttagttacgttaacgttacgttacgtacgtacgtacgtccggtaacgtcgtaacgtaccggtacgttcccggttacggtttaccgttaccggttaaccttccggggtaacccgacgggtaccgttaacgtcccggtaagtaacccggtaaccggttaaacccggtacgtaacggttcgtacggttacccaccgtctaacccgttcgttacgttaaccccg

SEQ ID NO: 175722 - DNA, 570 bp, Homo sapiens
  misc_feature: GYAE6OF02F56DD.12.23.C01.1.454.CMB.1.raw
  modified_base (203)..(203): a, c, t, g, unknown or other
  misc_feature (203)..(203): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
tcagatacgacgtacacgaccggtgctcgatttagtacacgtgattagggattgggggaggaactgctcagttaggacccagacggaaccatggaagccccagcacagcttctcttcctcctgctactctggctcccagataccactggagaaatagtgatgaagcagtctccagccaccctgtctgtgtctccgaggggaanagccaccctctcctgcagggccagtcagagtgttaatgcgacttagcctggtaccagcagatacctggccaggcctcccgaggcctcctcatctatggtgcatcaccgagggccagtggtactccagccaggttcagtggcnggtcggtntgggacaggtagttcactctacacctatcagcacgcctgctagtctagtaagtagtttgacttagtttacttacgtgttacagtactagttaataacttacgttcggttcctgtacttacgtacggtttccgggacgggggtaccgtagggtcggaagtacgtacgaaacggtaacgttggtaggtcgtcggaccgtacgtacgttccgtagttccg

SEQ ID NO: 175723 - DNA, 530 bp, Homo sapiens
  misc_feature: GYAE6OF02G3F8P.12.23.C01.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (407)..(407): a, c, t, g, unknown or other
  misc_feature (407)..(407): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccagggggaaangccaccctctcctgcagggccagtcagagtgttaangcgacttagcctggtaccagcagactacctggccaggcctcccgaggcctcctcatctatggtgcatctaccgagggccagtggtactcccagcccaggttcagtggctaggtggtctgggacaggtagttcactctcaccatcagcagcctgctagtctagaagtnttttgacttagtttattactgtcagctagtataatacgtggttcctgtcttcgtacgttcggggacggggactaggtggagtacgtaacgaaacgtacgtggtgcgtcgccacgtattctgtc

SEQ ID NO: 175724 - DNA, 706 bp, Homo sapiens
  misc_feature: GYAE6OF02I50WE.12.23.C01.1.454.CMB.1.raw
  modified_base (207)..(207): a, c, t, g, unknown or other
  misc_feature (207)..(207): n is a, c, g, or t
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtcctaccgaaggggaaanacgcccaccctctcctgcgacgggccagtcagtagttagttaaanacggcgtacttagcctaggtaaccagcagactaccgnggccaggcctacccgaggtcctcctcacttctagttcggtnactaactcctaaccggacgggtaccctaacgttcggtaacctccccgagtcccgtaaggttcaaggtcggacgagggttcgggtactaggggactacggtacgttaccacttccgtaccaacctataccgacgaccgtaccgtacgtcgtaccgtaacgttccgtaaggtaattaacgttttcgacgtttaaggttttacttaacgttgtaccgtagtaaccgtaaagttaacttaaacgttaccgtttcgttaaccgttcgttaccgttaccggttacgggtttaccgggggaaccggggtaacacgggggttacgtaacgtaacgtaaccgtaaggtaccgtaggtacggctacgacacgtgttcgtcgttacg

SEQ ID NO: 175725 - DNA, 735 bp, Homo sapiens
  misc_feature: GYAE6OF02JPOYH.12.23.C01.1.454.CMB.1.raw
  modified_base (205)..(205): a, c, t, g, unknown or other
  misc_feature (205)..(205): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccactggagaaatagtgatgaagcagtctccagccaccctgtctgtgtctccgaaggggaanacgcccaccctctcctgcacgggccagtcagtagtgttaatgcgtaacttagccgtaggaccagcaagtactaccgtcggaccacggcctacccgaggtccttaccctacgtaacttcgtaagttcgggttacacctacgttaccgtaacccggacgggtaccctacggttacggttaacctccccgaggtcccgtaagggtttccaaggttcgggacgtagggttcggggttacgtagggggaactaggttacgttaccaccgttacgtacccgaacctagtaccgacggtaccgtacgtccgtacggacctaggttactaaggtaaatttcgttttgacctttagttttactacgttgtactagtacttaaagttaacttaacgttccgttacgttccgtagtcctttaaccggtaccgggtttacggggggaaccgggttaacgaggggttaggaagtaaccttaaacgggtaaaccgtacgttcggggtacgaccgttacgacccgtactagtttccgtccttacg

SEQ ID NO: 175726 - DNA, 568 bp, Homo sapiens
  misc_feature: GYAE6OF02JEKMQ.12.23.C01.1.454.CMB.1.raw
  modified_base (205)..(205): a, c, t, g, unknown or other
  misc_feature (205)..(205): n is a, c, g, or t
  modified_base (565)..(565): a, c, t, g, unknown or other
  misc_feature (565)..(565): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgagggggaaanagccaccctctcctgcagggccagtcagagtgttaatgcgacttagcctaggtaccagcagactacctggccaggcctccccaggcctcctcactctagtggtgcatctaccgagggccacgtggtactcccagccctaggttcagtggctaggtggtcgtgggactaggtagttccactctccacctatcagcacgcctgctagttctagtaagtgttttcgcttagttttacttcgtgtcagtctaagttattaacgtacgttcggttcctgtccttacgtacggttccggggacggggtacctagggtcgacgtagtaaccgaaagtacgtggtcggtctcggaccactagttcctnttc

SEQ ID NO: 175727 - DNA, 698 bp, Homo sapiens
  misc_feature: GYAE6OF02II4SM.12.23.C01.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanacgccaccctctcctgcagggccagtcagagtagttaanagcgacttagcctaggtaaccagcagactacctggaccaggcctccgaggctcctnatctagtggtcgacattcctaaccgagggccctacgtgggtacttacccccgaggcccgtaagggttccaggttcgggactaggggttcggggtacctaggggactaggtaccgtttccaccgttccgacctaaccacgttccgaacgaccgaacgtcccgtagaccgtagttaccgtaggtaaacggttagttttacggtacgtttaacgttttaacttacgttacgttacgtacgacgtacgtacgtaacgtaccgtaacggtccgttaccgttaccgtttaccgttaccggttttcgggaccgtaacggggtaccgtaacggtcggtaacggaacggtacgtaaccgtaaacgtaacggttacggtacggtacgtacggtacctaccgtacttccg

SEQ ID NO: 175728 - DNA, 582 bp, Homo sapiens
  misc_feature: GYAE6OF02HPTM0.12.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaanagcgacttagcctggtaccagcagatacctggccaggctcccaggctcctcatctatggtgcatctaccgagggccacgtggtactcccagccaggttcagtggcaggtcgggtctagggacaggtgttcacttctacaccatcagcacgcctgcacgtctagtaagtagttttgcttagttttattacgttgtcagtctagtaattaattacgttggttcctgtcttccttaccgtttcgggaccggggggtaccgtagggtgggtaacggtaacgtaaccgtaaaacggtaacgttacggtagggtacgtacggtacctaaccgtacttccgtggttacc

SEQ ID NO: 175729 - DNA, 574 bp, Homo sapiens
  misc_feature: GYAE6OF02I3F7K.12.23.C01.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgttaatgcgacttagcctggtaccagcagataccgtggcccaggcctccccgaggtcctcctcatctatggtncatcctaccgagggccactggtactccgagcctaggttcagtcggctaggtcggtctagggacagtacgttcactctacaccgtatcacgcacgcctgactagtctagtaatagtttgacttagtttattacgttgtcagtctagttaactaattacgttcggttacctgtacttcgtacggtttcggggaccggggtactagggtcggaagtacgtaacgaaaccgtacgtggtacgacgttgacccgacgtattccgtgttaccg

SEQ ID NO: 175730 - DNA, 628 bp, Homo sapiens
  misc_feature: GYAE6OF02HDB69.12.23.C01.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (322)..(322): a, c, t, g, unknown or other
  misc_feature (322)..(322): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangcccaccctcncccgcacgggccagtcagagttagttaaatagcgtaacttagcctggtaccagcagataccgtggccaggcctaccccgaggccttccctacacttcctagtgggtncctactccaaccgacgggccctacgttggtacctcccgagtcccgtaggttccaggttcgcgtagggttcggggtctagggggactaggtacgttccacttcctaccgaacctatcagcacgcctgcagtctaggtaagttacgttttgactagttactttaacttctagttcagtactagttaactaacgttacgtcgttcctcgtcttacgttacggttccgggggacgggaacgtagggtgaacgtactaacgtaaacggagttacggcggtacgtacggacctaacttactcgttccgttac

SEQ ID NO: 175731 - DNA, 630 bp, Homo sapiens
  misc_feature: GYAE6OF02HV29R.12.23.C01.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangcccaccctctcctgcgagggccagtcagagtgttaangcgtacttagcctggtaccagcagatacctggccaggcctcccaggcctcctcatctagtggtgctatcctaccgagggtcccacgtcggtactccccgaggcccgtaagggttccgaaggttcggcgtagggttcggggtcgtggggaaccaaggtacgttccaccttctaccacctatcgaagccacgccctggccagtctagtaagttgttttgacttagttttacttacgttgtacagtactaagttaattaacgttacgttcggtttcctgtccttaccgttacggtttccgggggaccggggtaacctaaggggtggtaacgtacgtaaccgaaacggtacgttggacggtctacggacctaaccgtnttccgttnttcccg

SEQ ID NO: 175732 - DNA, 597 bp, Homo sapiens
  misc_feature: GYAE6OF02GZB3V.12.23.C01.1.454.CMB.1.raw
  modified_base (302)..(302): a, c, t, g, unknown or other
  misc_feature (302)..(302): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaagagccaccctctcctgcagggccagtcagagtgttaatagcgacttagcctggtaccagcagatacctggccaggctcccaggctcctcatctatggtncatctaccgagggccacgttcggtactccccgagcccgtaggttcaggtggcgtaggtgggtctggggacaggtagttcactctaccaccatcgagcagcctagcagtctagaagttattttgacttagttttacttactgtactagctaagttaattaaacgttacgttgtttcctgtaccttacgttaccgtttcggggaccgggggtaccgtagggttcgggacgtaacgttaaccgaaacgggtacttacgggtggtaccgttggtacccaccgtacgttcgtagttcccg

SEQ ID NO: 175733 - DNA, 779 bp, Homo sapiens
  misc_feature: GYAE6OF02G4Q42.12.23.C01.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacctgtctgtgtctcgaggggaaangccaccctctcctgcagggccagtcagagtgttaanagcgacttagcctggtaccagcagactaccgtggccaggcctcccgaggtccttcctacgattccgtagtgggttcgcctaacgttccctaacccggaggggcccctaacgttcgggttaacctacccccggaaggtcccgtaaggggtttcctaagggtcgggacgtaaggggttcgggggttaccgtagggggaacctagggttaccggtttccaccgttaccgtacccaacccttagttacccgagaccctaaccggtcccgttagacccgttaacggttattaacgggtaacgtttagtttttcggaaccttttaaacgggttttttaacttaaccggttgttaactaaccgggtaccttaaagtttaactaaaccgtttaaccggttcggtttcctacggttcctttaccggttaccggttccgggggaacgggggtaccctaagggggttcgaaacggtcgtaaacccgggaaacgttaccggttacgggttacgccgtaacggtaccctaccgtaggtttccgtacgtttaccg

SEQ ID NO: 175734 - DNA, 605 bp, Homo sapiens
  misc_feature: GYAE6OF02H99HR.12.23.C01.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaagngccacctcncctgcagggccagtcagagtgttaanagcgacttagcctggtaccagcagactacctggccaggctcccgaggcctcctcatctatggtncatctaccgnggccacgtgtactcccagccaggttcaggtgcaggtgggtctgggacaggtcgttcacttctcaccagtcagcacgcctgcgtagtcgtagaagttattttgacttaagttttacttacgtgttcagtactaagttaacttaaagttaacgttcggttccttagttccttaccgttacggtttccgggggaccgggggtaaccgtaaggggttacggtacggtaacgtaaccgtaaacggtaccgtttaggcggtacgtcggtaacctaccgtacttccgtagtttcccg

SEQ ID NO: 175735 - DNA, 664 bp, Homo sapiens
  misc_feature: GYAE6OF02IHE8O.12.23.C01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccactggagaaatagtgatgaagcagtctccagccaccctgtctgtgtctccaggggaanagcccaccctntcctgcagggccagtcagagtgttaatgcgattagcctggtaccaggcagactacctggccaggctcccgaggcctcctnatctatcgatgacataccgaaaagggccactcggcactcccagccaggttcaggtgcaggtgggtcnggggcagtacttcactctacaccatcacgtcacgtccgtaagcgaccgtaggtaacgtagtttttcggacttaacgtttttaatttaccgttacggttactaacggacgtaacggtccggttaacgtaccgtaaaccggtcgggttacccgttaccgggttttaccgttaccggtttttccgggacccgttaaaccgggggacccgtaacgggacggttacgggaaacgtaacgttaaccgaaaaccggttaaccggtaggtttacggggaccgttaccggtaaccctacccgtagttacccg

SEQ ID NO: 175736 - DNA, 619 bp, Homo sapiens
  misc_feature: GYAE6OF02IPNKE.12.23.C01.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagcccaccctctcctgcagggccagtcagagtgttaatagcgtacttagcctggtaccagcagatacctggccaggcctcccgaggctcctcatctatggtncatccaccgagggccacgtcggtatcccgagcccgtaggttcagtcggctaggtgggtctagggacgtagtagttcacttctacgaccatccagccaagcctcgacacgtctagtagttatttgacttaagtttattacctgtacagtctaagttactaaattaacgttcggttcctagtctttcgtacggtttacggggaccgggggtacccgtagggtacggtaaggtaacgttaaccggtaaacggtaaccggttagggtaccggtacggttcggaacccgtaccggtaacgtttccgttagtttacccg

SEQ ID NO: 175737 - DNA, 598 bp, Homo sapiens
  misc_feature: GYAE6OF02IR1OG.12.23.C01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaancgccaccctntcctgcagggccagtcagagtgttaangcgacttagcctggtaccagcagactactggcccaggcctcccgaggctcctcatctatggtncatcaccgagggccacgtggtactcccgagtcctaggttccaggtggctagggtcgggtctggggacaggtacgttcaccttcgtaccaccctaatccgacgccacgcctgcctagtcgtacgtaagttagttttgacgttagttttattacgttgtctacgtactagttaattaacgttacgttggttaccgtgtcttacgtacggtttacggggacgggggtaccgtagggtaggaggtacgtaacgaaacggtaacgtggtacggtcgtagtaccgtaacgtcgtcctgttcc

SEQ ID NO: 175738 - DNA, 613 bp, Homo sapiens
  misc_feature: GYAE6OF02HWG9W.12.23.C01.1.454.CMB.1.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanacgccaccctctcctgcacgggccagtcagagtagttaatagcgtacttagccgtggtaccagcagactaccnggccaggcctccaggctcctcactctagtggtnctatcctaccgagggcccactggtactcccagtccgtaggttcaggtcggcagggttcggactgggaacnggtacgttctaccgtctacaccagtccagccagcctgctagtctagaacgttntttacgactttaagttttactttacgtggtacacggtaacttagttaaagttaacttaccgttcgtttaccgtgtacctttcgtacggtttcgggggaccggggtacctagggtcggtacgtaacgtaacggtaaacctgggtacgtcggtacgtacggccttaactcgttcttacgtttc

SEQ ID NO: 175739 - DNA, 572 bp, Homo sapiens
  misc_feature: GYAE6OF02FV3ZK.12.23.C01.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanagccaccctctcctgcagggccagtcagagtgttaatagcgacttagcctggtaccagcagatacctggccaggctcccaggctcctnatctatggtncatcctaccngggccacgtggtactcccgagccagggttcaggtggcaggtggtctgggaacaggtagttccacttctacaaccatcagcgagcctgctagtctagtaagtagttttgacttaagtttattacgtgtacagctaagttaattaaacttaacgttcggttcctgtccttacgtacggttttccggggacgggggaccgtagggtacggagaagtaccgaaacgtacgttaggtcggctacgaccacctacgttctggttcc

SEQ ID NO: 175740 - DNA, 139 bp, Homo sapiens
  misc_feature: GYAE6OF02GYAB3.12.23.C01.1.454.CMB.1.raw
  modified_base (130)..(139): a, c, t, g, unknown or other
  misc_feature (130)..(139): n is a, c, g, or t
tcagatacgacgtacacgaccggtgctcgatttagtacacgtgattagggattgggcacagcggccctgggctgcctggtcaaggactacttcctacgtcgtatctgagcgggctggcaaggcgcatagnnnnnnnnnn

SEQ ID NO: 175741 - DNA, 647 bp, Homo sapiens
  misc_feature: GYAE6OF02HUTQ9.12.23.C01.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (492)..(492): a, c, t, g, unknown or other
  misc_feature (492)..(492): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccacctgtctgtgtctccgaggggaaanagcccaccctctcctgcgagggccagtcaggagtgttaatagcgtacttagcctggtaccagcagactaccgtggccaggcctcccgaggtcctcctcactctatggtcncatcctaccgacgggcctacgtggtactcccgagccgtaggttcaggtcggacgtagggttggggtaccgtagggaacgaggtacgttccacttcctaccaacctactcagccacggtccctagacctaggtctaaggtaagtttacgttttgactttaagtttttacttacttgtacngtatagttaaattaagttacgttggttcctacgtcttaccgttacggtttaccgggggacggggtaaccgtagggtaggacgtaacgttaaccgaaacggttacgttggtacggtaccgtacggtaccctaacgttacgttaccgttacgttccg

SEQ ID NO: 175742 - DNA, 626 bp, Homo sapiens
  misc_feature: GYAE6OF02JIVTS.12.23.C01.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (580)..(580): a, c, t, g, unknown or other
  misc_feature (580)..(580): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaangccacctntcctgcagggccagtcagagtgttaanagcgacttagcctggtaccagtcagactactggccaggcctcccgaggctcctcattctagtggtcgcatcctaccgaggggccctagttcggtactccccgaggcctagggttcaacggttcgggactaggttcggggtcctggggactaggacgtttccacttcctaccaccgtattccgaagctaacggccgttagacctacggttactacggaaaggttactttttggaacttaaggttttattaacgttggtactacggactaaggttaattaaacgttacgtcgtttacctgtcttaccgtaccggtttcggggaccggggtactaggcggaacgtntaaccgaacggtaactggtgtacgtgacctaccgattcggcttccg

SEQ ID NO: 175743 - DNA, 745 bp, Homo sapiens
  misc_feature: GYAE6OF02H7NQL.12.23.C01.1.454.CMB.1.raw
  modified_base (205)..(205): a, c, t, g, unknown or other
  misc_feature (205)..(205): n is a, c, g, or t
  modified_base (495)..(495): a, c, t, g, unknown or other
  misc_feature (495)..(495): n is a, c, g, or t
  modified_base (625)..(625): a, c, t, g, unknown or other
  misc_feature (625)..(625): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgagggggaaanacgcccacccctctcgtcgacggacggctacgacgaggtagttaagttaagacggacgttaacttacggtaccgtacgtaccgacgtacgaagtacctacggtccggaccgacgtacccctccggacgtccctctactctactaggtcggtacactactaccgtaccggaccggacctacgtacggtacccaccgtacgtaccggtacgtacggtggtacggacggttgggtcgggtacggtacggtaacgtaggttacctcctaccttccgacctaccagttaccgganaaccgtccgtacgttaccgaacgtggttacgtaagggttatttaccgtttaagttaccttttaagtttaccgttacgtaacgttccagtaacgttaacgttaaaatttaaccggtcgttttaacccggtntaaccgtttccgttaccgggtttacggggtaaccgggggaccggtaacgtaagggacgttaacggactaaaccgacggttaagtcggtcgatacgtaacctacgtagttccgtacttacc

SEQ ID NO: 175744 - DNA, 747 bp, Homo sapiens
  misc_feature: GYAE6OF02G8H5W.12.23.C01.1.454.CMB.1.raw
  modified_base (208)..(208): a, c, t, g, unknown or other
  misc_feature (208)..(208): n is a, c, g, or t
  modified_base (718)..(718): a, c, t, g, unknown or other
  misc_feature (718)..(718): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctccagcccaccctgtctgtgtcctccgaaggggaaanacgccctaccctctcctggcgacgggaccaggtcaggtagttagttaaacagcgtacttagcctaggtaccagtccaagtactaccgtgaccgacggtcctaccgacggtcctccgtacacttcttaagtcggtagacctacttccgaaccgaccgggtaccctaacgtcggtaacctaccccggaacggtacccgttaagggttcaacgggttcggaccgtaggggttcgggttacgggtacgggaaacgtacggttaagtttacccgaaactttccgtaaccctaccgtaactaccgacgaccgtaccgtcccgtagacgtacgttacgtaggttaacgtttacggttttactacggtttaaagtttttacgtacgtacgtactagtaccttaaagttaataaacgtttacggttacgttcctagtccgtttacggtaacggtttcgggggaccgggttaacaggggttataacggtaaccggtaacaaacggtgtcggtacgtaccnccgtaacgacttacgttccgttacttacg

SEQ ID NO: 175745 - DNA, 632 bp, Homo sapiens
  misc_feature: GYAE6OF02HBCP5.12.23.C01.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaatgtgatgaagcagtctccagccaccctgtctgtgtctcaggggaangccacctctcctgcagggccagtcagagtgttaangcgattagcctggtaccagcagataccgtggccaggcctcccgaggctcctcatctatggtgcatcctacgagggcctactggtactcccagccctaggttccaggtcgctagtgggtctggggacaggtgtcactcgtcaccatcagcagcctgctagtcgtagaaacgttgttttcgacttaaggttttacttacgttcggttacaggtaccgttaaagttaattaaaaccgttaccgtttacggggtttaccccttagggtaccctttaccggtaaccggtttttccggggggacccgggggttaaccgtagggtaccgggtaagtacgtaaccggtaaacggtaacgttacggttcggacgttacggacctaaccggtacttcggttacgttcc

SEQ ID NO: 175746 - DNA, 708 bp, Homo sapiens
  misc_feature: GYAE6OF02GQIIZ.12.23.C01.1.454.CMB.1.raw
  modified_base (205)..(205): a, c, t, g, unknown or other
  misc_feature (205)..(205): n is a, c, g, or t
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
  modified_base (680)..(680): a, c, t, g, unknown or other
  misc_feature (680)..(680): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctccgaggggaaancgcccaccctctcctgccgagggccagtcagtagtgttaangctacttagcctggtaccagcagactaccgtggccaggcctcccgaggtcctccctctactctagtgggtcnctactccgaccgacgggccctacgtcggtacctccccgagtcccgtaggttccaggttcgggactagggtcgggttacgtcgggaactaggtacgtttccaccgttcccgtactaacccgtattcccgaacgtcctaacggtcccgttacggacccgtagttaccgtaacggttaagttaacgtttttcgacgtttaagttttactttacgttgttcgtagttaccgtaaaggtttaacttaaactttaaccgtttcggttaccttcgttaccgttaccgttacgggtttacccgggggaccgggggttaaccgtaggggttacgaacggtacgtaaccgtaacggtacgttggtacggtcncggtacctaccgtagttcgtcgttaccg

SEQ ID NO: 175747 - DNA, 649 bp, Homo sapiens
  misc_feature: GYAE6OF02IE2EQ.12.23.C01.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (636)..(636): a, c, t, g, unknown or other
  misc_feature (636)..(636): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaangccaccctctcctgcagggccagtcagagtgttaanagcgattagcctggtaccagcagataccgtggacctaggcctccccaggcctcccgtacacttcgtactgggtncactcgtaaccgacggggccctaaccgtgggtaaccttccccgaggtccctaaggttccgaggtcgggacctagggttcggggtctaggggacaggtacgtttcacgttcctaccgtaccagtcaggcctacggtcctacgggtactaacgttcgtacggtaagtacgttttggaccgttaagttttacttacgtcgttactacggtataacgttaaattaacgttaacgtggtttcctagtcgttaccgtacgtttcggggacggggtaccagggtcggtaagtacgtaacaacggtacgtaggtcggtactgaccgtaaccngttaccgtgtacg

SEQ ID NO: 175748 - DNA, 517 bp, Homo sapiens
  misc_feature: GYAE6OF02I9YGP.12.23.C01.1.454.CMB.1.raw
  modified_base (203)..(203): a, c, t, g, unknown or other
  misc_feature (203)..(203): n is a, c, g, or t
  modified_base (512)..(512): a, c, t, g, unknown or other
  misc_feature (512)..(512): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccactggtatcccagcctaggttcagtggcaggtggtctgggacagagttcactctcaccatcagcagcctgcagtctgaagtattttgctagtttattacgtgtctagctagtataattactgttcctgtctctacgtttcggcggggtacagggtggagtgtacaacgtaacgtgtacggcgtgaccacctagtctntaccg

SEQ ID NO: 175749 - DNA, 596 bp, Homo sapiens
  misc_feature: GYAE6OF02JFW4D.12.23.C01.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (411)..(411): a, c, t, g, unknown or other
  misc_feature (411)..(411): n is a, c, g, or t
  modified_base (578)..(578): a, c, t, g, unknown or other
  misc_feature (578)..(578): n is a, c, g, or t
  modified_base (587)..(587): a, c, t, g, unknown or other
  misc_feature (587)..(587): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgttaangcgacttagcctggtaccagcagataccgtggccaggcctcccgagcctcctcatctagtggtncatcctaccgnggccatggtacncccagcctaggttcagtggactaggtcgggtctgggacaggacgttcactctcacagtcagcagcctgcagtcgtagaacgttnttttcgacttagttttacttacgttgtactacgactaagttaattaacgttaacgttcgtttacctcgtccttcggttaccggtttcgggggacccgggggtactagggtcggtaacgtaacggttaacgaaacggtacgttggtacggtccgtgtacccgtaccgngtttaccgngtttacccg

SEQ ID NO: 175750 - DNA, 666 bp, Homo sapiens
  misc_feature: GYAE6OF02IX4EP.12.23.C01.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
  modified_base (396)..(396): a, c, t, g, unknown or other
  misc_feature (396)..(396): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctggtgtctacgtaggggaaancgccacccttctcctgcagggtccagtcagagtgttaaangcgacttagctggtaccagcagataccgtggccaggcctccgaggtcctcctacgattcctagtcggtnactactccgtaaccgagggtcccaagttcggtactccccgagtcctaaggttcaggtcggactagggtgggtctgggaacnggtacgttcgacttccacgaaccgattcgaacgacctacgtccgttggcccgtaggttcgtacggtaagttacgtttttacgacgttaagttttacgtacgttacggtactacggtacgacgttaccggttagaacccgtacgtttacgggcccgtttacggttaccgttacggtttacgggacccgaacgggttacccgaagttaccggtaggaacgtataaccgaaacgtacgtcggtacgtccgtaggacccgtacgtacgttaccg

SEQ ID NO: 175751 - DNA, 735 bp, Homo sapiens
  misc_feature: GYAE6OF02JTEC1.12.23.C01.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (468)..(468): a, c, t, g, unknown or other
  misc_feature (468)..(468): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctcgaggggaaangccacctctcctgcagggccagtcagtagtgttaatacggcgacttagccgtggtaaccngcagtactacctggccaggcctcccgaggcctcctacgatcgtagtggtcgacctagttaccgtaccgacgggcccctaggttcggaccttaccccgacggtacccgtacgggtttaccgacggtcgggtacgtacgggttcgggggtaccttggggaaacctagggttacttccgacttccgtaccacgtacttacgacgtacncggtacccctggcctaagttcgtaaggtaagtttcgttttacggctttaagttttaccgtcgttacggtactacggtacgttaaagtttaaacgttaacgttaccggtttcgggttaaccctggtaaccgtttcgttaacggggttttacccggggggacggggttaaccggttagggtaggaagttaaccctaacggggtaaacctttaccggtgggttaaccgttcgggacgtaaccgtacccggtagtttccgttacccgttac

SEQ ID NO: 175752 - DNA, 733 bp, Homo sapiens
  misc_feature: GYAE6OF02HU5J9.12.23.C01.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (675)..(675): a, c, t, g, unknown or other
  misc_feature (675)..(675): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatggaagcagtcctaccacgcccaccctgtcctgtcgtacctaccggaaggggaaacgcgcccacccttctccgtgcgacgggccctagtcaaggtagttagttaaatggacgtacttaggcccgtaggtaccngacagtacttaccgnggaccacggcccttacccgacggtcctccctactacgttaccgtagttcgggtctacacgttacccgaccggcgggaccctagttcgggtaccctacccgacgtacccgtaaggttccgaggttcggtacgtacggggttgggtacggtacgggacgtacgggttcgttacctaaccgtctaccaccgtagttaccgagtccgtacggtccccgtagtccgtaacggttcgtaaacgggttaacgttttgttttaccgtaaccggttttagttttaccgttacgttcgtatacggtacgtaagttaacttacgttacgttcgttactcgtactacggtcggtcgggacgggtactagggcggtaancggtaacgtacgtacggtcgtacggtcgtacgtacccgtaggttacctcgtcttaccg

SEQ ID NO: 175753 - DNA, 559 bp, Homo sapiens
  misc_feature: GYAE6OF02IP6R8.12.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangcccaccctctcctgcagggccagtcagagtgttaatagcgacttagcctggtaccagcagatacctggccaggctcccaggctctcatctatcggtncatctaccgngggacctactggtactcccagccgagttccagtggcagtggtctgggacagagttcacttcncaccatcagcagcctgcagtctagagtntttagcgttagtttattactgtacantaagtataataactgttcctgtccttcgtacggtttaccgggacgggggtaccgtagggtcggtaacgtacgtaaccaaacggtacgttaggtcggtactcggacctaaccgtacgtttaccgtacgttcg

SEQ ID NO: 175754 - DNA, 756 bp, Homo sapiens
  misc_feature: GYAE6OF02H00M8.12.23.C01.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctcgaggggaaancgcccacctctcctgcgagggccagtcagtagtgttaagagcgtacgttagcctggtaccagcagactaccgtggccaggcctcccgaggccttcctcacttccgtagtggtancctaacgttccaaccgacgggtccctaacgttacgggtacctaccccgaggccctagggtttccaagggtcggtcgaagggttcgggtacgtacgggactacggtaacgtttccaccttccgtacaacccgtactacgacgtacctacggccttcggactacggttccgtaaggtaagttacgttttacgtacgtttaagtttttacgttactgttacgaacgtacgttaaggttaaactttaaacgttacgtttaccggtttccttagttacccgtttacgggttaacccgggtttaccgggggtaccgggggtaaccgttaaggggtacgggtaaccggtaacgtaaaccgggttaaaccgtaacggtttacggtaccgggtaccgttaaccggtaacccttaacccggttacgtttacccggttagttttacccgg

SEQ ID NO: 175755 - DNA, 578 bp, Homo sapiens
  misc_feature: GYAE6OF02HLKMY.12.23.C01.1.454.CMB.1.raw
  modified_base (161)..(161): a, c, t, g, unknown or other
  misc_feature (161)..(161): n is a, c, g, or t
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (394)..(394): a, c, t, g, unknown or other
  misc_feature (394)..(394): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (544)..(544): a, c, t, g, unknown or other
  misc_feature (544)..(544): n is a, c, g, or t
  modified_base (553)..(553): a, c, t, g, unknown or other
  misc_feature (553)..(553): n is a, c, g, or t
tcagatacgacgtacacgaccggtgctcgatttagtacacgtgattagggattgggggaggaacgtgctcagttaggacccagacggaaccatggaagcccagcgcagcttctcttcctcctgctactctggctcccagactaccacgtggaagaaatagngatcgaagctagtcctccagcccaccctgtcctgtcgtcctaccgaggggaaaancgcccaccctctcctgcgacgggtccagtcaggtagtgttaanaggctaattgcctggtaccaggcagatacctggacacgctcccgagtctctcatctagtgncatccaacgnggacagtcgactcccagccgtaggtcaagcggtcaggttgggtctaggacctaggtcttcgacnctacccatagcaagcacgtcngtacngtcttagattatttgactttaattacgtcaggttcaagttacagtaattaacctaggtgtcccttaagccttactacggttcggggcgggaatagggtcgagaacgttaacaaacgaggtttgngggttaacnggtaccaaccgtgtttcgtcgttac

SEQ ID NO: 175756 - DNA, 136 bp, Homo sapiens
  misc_feature: GYAE6OF02G6L02.12.23.C01.1.454.CMB.1.raw
  modified_base (130)..(136): a, c, t, g, unknown or other
  misc_feature (130)..(136): n is a, c, g, or t
tcagatacgacgtacacgaccggtgctcgatttagtacacgtgattagggattgggcacagcggccctgggctgcctggtcaaggactacttcctacgtcgtatctgagcgggctggcaaggcgcatagnnnnnnn

SEQ ID NO: 175757 - DNA, 749 bp, Homo sapiens
  misc_feature: GYAE6OF02H1K5O.12.23.C01.1.454.CMB.1.raw
  modified_base (152)..(152): a, c, t, g, unknown or other
  misc_feature (152)..(152): n is a, c, g, or t
  modified_base (249)..(249): a, c, t, g, unknown or other
  misc_feature (249)..(249): n is a, c, g, or t
  modified_base (287)..(287): a, c, t, g, unknown or other
  misc_feature (287)..(287): n is a, c, g, or t
  modified_base (324)..(324): a, c, t, g, unknown or other
  misc_feature (324)..(324): n is a, c, g, or t
tcagatacgacgtacacgaccggtgctcgattttagtacacgtgattagggattgggggaggaactgctcagttaggacccagacggaaccatggaagccccagcgcagcttctcttcctcctgctactctggctcccagataccactgganaaatagtgatgaagcagtctccagccacctgtcctgtgtctccgaggggaaagacgcccacctctcctagcagggccaagtcagtagtagtttaaanacggcgtacttaagcctaggtaccagccagactaccgnggccaggctcccgagctccactatcttagtcgggtancctagtcctaaccgagggtccctaacgtggtaacctcccgaagtcccgtaaggttccgaggttcggacgtacgggtggggttcgaagggtacaaggtcgttacctacgttaccgtaccaaccaacgttcgacgtcgaacgccccgttagcccgtaagttaccgtaaggtaaacgtttagttttacgtaacgtttaacggtttttaacttaacgttacggtaacgtacggtacttaaacgttaagttaaacgtttaaaccgttggttttacccgtacgttacttaccggttaccggtttacggggtaaccggggggtaaccgtaaggggttacggtaaggtaacgttaaacccggtaaacggtaacgttaggtaacggtccgttacgggtaaccctaaccggtacgtttacccgtggttttaaccc

SEQ ID NO: 175758 - DNA, 718 bp, Homo sapiens
  misc_feature: GYAE6OF02GJ871.12.23.C01.1.454.CMB.1.raw
  modified_base (504)..(504): a, c, t, g, unknown or other
  misc_feature (504)..(504): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaagacgccaccctctcctgcagggccagtcagagtgttaatacgcgtacttagcctaggtaccagcagtactaccgtggaccaggtcctccccgaggccttccctcacttctagtggtcgccattccgtaaccgagggacccctagttacgggtactaccccgaggtcccgtaagggttccaaggtcgggtactaagggttcggggtcgtagggggaacctaggtacgtttccaaccgttccgtaccaacctagtccaacggtccacggtcccgtggaccgtaggttcgtaggtaaacggtttntttttacggacctttaagtttttacttacgttagtaccagtacgttaaggttaaacttaagttaccgtttcgggtttacccttggtccctttacggttaccgggttttaccggggggaccgggggtaacggtagggttcggaacgttaacgaaccggtaaacggtacgttcggggcgtaccggtcacccgtaacgtcgtttcgtcggtttaccc

SEQ ID NO: 175759 - DNA, 659 bp, Homo sapiens
  misc_feature: GYAE6OF02HK2J4.12.23.C01.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccaatggagaaatagtgatgaagcagtctccagccaccctgtctgtgtctccgaaggggaaaanagcccaacccctctcccgtgccgaggggccagtcgagagttagttaaatagcgacttagcctaggtaccagcagatacctggccaggcctcccaggctccnatctatggtncactctaccgagggccacgtggtactcccagcctaggtcagtggacaggtcgggttctagggaactaggagtttaccgaccttctaccgtaaccatcgacgctaacgcccttagctaagtcgtaacgtaagtattttgacgttaagtttttactaacgttgtacaaggtacctaaggttaacttaaaagttaacgtttggtaccttagtccgttaacctacgggtttacgggacccggggggtaacgtaaacgggtggtaaccgtaaacgtaacgtaaaaaccggtaacgttaggtacggtacgtcgaacccgtacctaacggttacgttaacgttacccgg

SEQ ID NO: 175760 - DNA, 884 bp, Homo sapiens
  misc_feature: GYAE6OF02HMWQP.12.23.C01.1.454.CMB.1.raw
tcagatacgacgtacacgaccggtgctcgatttagtacacgtgattagggattggggggaggaactgctcagttaggacccagacggaaccatggaagccccagcgcagcttctcttcctcctgctactctggctcccagataccactggaagaaatagtgatgaagcagtctccagcccaccctgtctgtgtctaccggaggggaaagcgcccacctctcctgacagggccagtcagtagtagttaatagcgtacttagccgtaggtaccagcaagtactacccgtggaccaggcccctacccgacggtccttccctactacttcttaaggtcggttacacctacttcccgaaccggacgggaccctacgttcggtacctcccgacggtaccgtacgggttcaacgggttcgaccggtagggttcggggtacgtggggaaccaaggttcgttaaccgaacccttccgtacccgtaacccgtagttacccggacgtacccggtaccgtaccgttcggaacggttacggttaccgttaaagggtaaacgtttttcgttttaagtaccgttttaaaggtttttacgttaccgttaacgttaccgtaaggtaactttaaacggtaaacgttttaaaccgtttaaaccggtttccggtttaccttaccggttttacttaaaccccggggtttaccggggttttaacccgggggggaaacccggggggtttaaacgggtaaccggggggtttaacggtaaaccgggtaaccgggtttaaaacccggtaaaacgggtttaacccggggtttacgggtaccggggtttacccttaacggggtaaccccctaaacccggtttacgggttttcccctttacggggtttacccc

SEQ ID NO: 175761 - DNA, 662 bp, Homo sapiens
  misc_feature: GYAE6OF02GAKD9.12.23.C01.1.454.CMB.1.raw
  modified_base (317)..(317): a, c, t, g, unknown or other
  misc_feature (317)..(317): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaagacgcccaccctctcctgcacgggccagtcagagtagttaatagcgacttagccgtaggtaccagcagactaccgtggccaggcctcccgaggtcctccgtcactctacgtggtnaccatccgtaccgacggggcccacgttcggtactcccgacgccgtaggttaccgaggtcggcgtgggtcgggtcgtgggaacgaggtacgttccacttccaccaaccgtntaccgacgtaccacgtaccgtnaccgtagtctaggtaagttnttttacgacgttaagttttacttcgtagtacagtactaggttaaataacgttaaccgttcgttaccgtgttaccttaccggttaccgggtttaccgggggacggggtaacggtagggtacgggaactacggtaaacgtaaacggtaccggttaggtacggtaccgtcggtacctacctaaggttcctagttcc

SEQ ID NO: 175762 - DNA, 669 bp, Homo sapiens
  misc_feature: GYAE6OF02JMDR3.12.23.C01.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (320)..(320): a, c, t, g, unknown or other
  misc_feature (320)..(320): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctcgaggggaaangccaccctntcctgcgagggccagtcagtagtgttaangcgtacttacgcctggtaccagcagactaccgnggaccagggcctcccgaggccttccctcattccgtagtcggtacncctatccgtaccgacgggtcctacgtggtacctcccgagcccgtaggttcagtggctagggtcgggtactcgggaacgaggttacgttccaccgtctccaaccgtatccgagcctacggtcctagcgtagttcgtagtaacgttcttttgactttaagttttacttcgtcgtactaacggtctaagttaacttaaacgtttaccgttggttaccctgtacccttacggtaccggtttcgggggaccggggtaactaggggttacggtaacgtaaccgtaaacgtaaaccgggtacgttcgggtaggtaccttacgggacccttaccggtttacttcggttaccgttccg

SEQ ID NO: 175763 - DNA, 552 bp, Homo sapiens
  misc_feature: GYAE6OF02F6LTJ.12.23.C01.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgttaatagcgacttagcctggtaccagcagataccgtggccaggctcccaggctcctnatctagtggtgcatctaaccgagggccacgtggtactccccgagccgaggttccaggtggctaggtgggtctggggacaggtacgttcacttctcaccatcacgcacgcctgcacgtctagaagtcttttgattagtttattactgtctagctaattataattaacgttggttctgtccttcgtacggtttcgggaccggggtactaggggtgacgtagtacgaaacgtagtggtgtcgtgacctacacttcgtgttacc

SEQ ID NO: 175764 - DNA, 631 bp, Homo sapiens
  misc_feature: GYAE6OF02H0O7R.12.23.C01.1.454.CMB.1.raw
  modified_base (204)..(204): a, c, t, g, unknown or other
  misc_feature (204)..(204): n is a, c, g, or t
  modified_base (320)..(320): a, c, t, g, unknown or other
  misc_feature (320)..(320): n is a, c, g, or t
  modified_base (608)..(608): a, c, t, g, unknown or other
  misc_feature (608)..(608): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanacgcccaccctctcctgcagggccagtcagagtgttaatgcgtacttagcctggtaccagcagactaccgtggccaggcctcccgaggcctcctcatctagtggtgcatctaccgngggccctagtcggtactcccgagtcccgtaggttcaggtcggcgtagggtgggtacgtggggaactagggtacgttaccacttccaccgtaccagttccacgtcctacgtcccgtagccgtagttcgtagtaagttagtttttcgacgtttagttttacttacgttgtacgtagtacgtaattagttaaacgttacgttcggtttacctagttccttccggttaacggttccggggacggggtaccgtagggtacgacgtaacgtacgaaacggtacgtggcggtacncggtactacctacgtcgttgtcc

SEQ ID NO: 175765 - DNA, 768 bp, Homo sapiens
  misc_feature: GYAE6OF02JXQC8.12.23.C01.1.454.CMB.1.raw
  modified_base (339)..(339): a, c, t, g, unknown or other
  misc_feature (339)..(339): n is a, c, g, or t
tcagatacgacgtacacgaccggtgctcgatttagtacacgtgattagggagttgggggaggaacgtgctcagttaggacccagacggaaccatggaagccccagcgcagcttctcttcctcctgctactctggctcccagataccactggaagaaatagtgatgaagcagtctccagccaccctgtctgtgtctcgagggaagacgccaccctctcctgcgaacgggtccagtccgaggtacgttagttaacaggtctacttaggccttaggaacccgagcctaaggtacctacccgtacggggacctacgggtcctacccccgagggtcctaccctntaacttccgttagtacgggtctacactttacccgaccggacgggcccctaagttcgggtaacctccccgaacggtcccgtaaagggttccctaagggtccgggtacaacggggtttcgggggtcctaagggggtacctaagggttacccgtctttaccgacccgttaccacggtatccgacgtacgtaccgtccgtacgtcgtaccgtctaaggttaacttaccgtttagctttaacgtttagttacccgtagttccgaaagtccgttaaagttacgttaaagtttaccgtttacggttcgttacgtaccgttccggttaacggttaccggggaaccggggttaccgagggttcgtaaacggtaacgtaaccgttaaacggtacgtacggtgttaccgtcggaaacctcggttccttgtactttacccg

SEQ ID NO: 175766 - DNA, 735 bp, Homo sapiens
  misc_feature: GYAE6OF02FRWSF.12.23.C01.1.454.CMB.1.raw
  modified_base (203)..(203): a, c, t, g, unknown or other
  misc_feature (203)..(203): n is a, c, g, or t
  modified_base (666)..(666): a, c, t, g, unknown or other
  misc_feature (666)..(666): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatgtgatgaagcagtctcagccaccctgtctgtgtctccgaaggggaaancgccacctcgtccgtgcacgggccaagtccgaggtagtagttaatcgcgtacttacggccgtaggtacccagtcaacgtactaccgtggaccaggccctacccgaggtccttcccgactacgttcgtaaggtcggtagacctattaccgaccggacgggtccctaacgttaggtaacctaccccgaaggtacccgttaagggttacctaaggtacgggtagtaagggtttcggggaccgtttaggggaaaccttagggtaacggtttccaacgtttcccgtaccgaaccgtaattccgacgtacgtacggtacctcggaccttaggttaccgtaaggttaagttacgtttcgacgtttaagtttacgttacgtacgttacgtacgtactaaagttaagtaacgttaccgttcgttacctacgttacgttaccgttacgggttaccgggacggggtacgtaagnggtaacgtacgtaaccggtaacgtcgtacggtcgtacgtacgaccgtaaccgttagtccgtgttacccg

SEQ ID NO: 175767 - DNA, 768 bp, Homo sapiens
  misc_feature: GYAE6OF02G0C6Z.12.23.C01.1.454.CMB.1.raw
  modified_base (204)..(204): a, c, t, g, unknown or other
  misc_feature (204)..(204): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccacctgtctgtgtctccgaggggaaancgcccaccctctcctgcagggccagtcagagtagttaatgcgtacttagcctggtaccagcagtactaccgtggccaggcctacccgaggccttccgtcattctagtggtcactacgtcctaccgacgggtccctaacgttcggtaacctccccgaacggtcccgtaagggtttccgaaggttcggacgttaggggtcggggttaccgtaggggaactagggtacgttccctaaccgttcctacccaaccgtagtccgaacgtccctaacgtcccgtagaccgtacggttaccgtaaggtaagtttactttttcggaacttttaaggttttacttaacggttcgtacgtaacggtacttaaaggttaactttaaaacgttacgttttccggtttacccgtcgttacccgttaccggtttacccgggtttaccgggggggaccggggggtaaaccttagggggttcggtaaacgtaacggttaaacccggtaaaaccgggttacgttacgggttacggtacccgttacggtaacccgtaccgtacgtttaccggttatttccccg

SEQ ID NO: 175768 - DNA, 902 bp, Homo sapiens
  misc_feature: GYAE6OF02HWEXW.12.23.C01.1.454.CMB.1.raw
  modified_base (211)..(211): a, c, t, g, unknown or other
  misc_feature (211)..(211): n is a, c, g, or t
tcagatacgacgtacacgaccggtgctcgattttagtacacgtgattagggattggggggaggaactgctcagttaggaccagacggaaccatggaagccccagcgcagcttctcttcctcctgctactctggctcccagataccactggaagaaatagtgatagaagccagtcctccagcccaccctgtctgtgtctccgaaggggaaanacgccctaccctctcctggacgacgggcccagtcaaggtagttaggtttaaacaggaccggtaaccgtttaggcccgttagggtaacccgtacgaccgtaacggtaacgttacccgtacgggaccaacgggtcccttccccgaacgggtcccttccccgtactaacttccttaaggttcggggtcgtactaacgttacccgtaaccgggtacggggtacccctacggtttcggttaccctaccccgacgggtacccgttaaggggtttaccacgggttcgggaccgtacgggggtttcggggttccgggtacgggggtaacctaggggttaactttacccgtaacccgttcccttaccggaaccctacggtaccgtaacgaccgaccggtccccgttacggtaccgttacggttacgttaacggtaacgtttacgtttttacgaccgtttaagtttttaactttacgttcggttacgaacggttataacgttaaatttaacgttacggtttaccggttttaccgtacgttaccgttttacccggttaccggggtttaccgggggtaccggggggtaacccggttaggggtacgggtaacggttaacggtaaaccgggttaaacgttaccgggtacggttacgggtaccgttacggaacccgttacccgtacgtttccggttccgtttaccg

SEQ ID NO: 175769 - DNA, 808 bp, Homo sapiens
  misc_feature: GYAE6OF02JYHVL.12.23.C01.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagatacgacgtacacgaccggtgctcgatttagtacacgtgattagggagttgggggaggaactgctcagtttaggacccagacggaaccatggaagccccagcgcagcttctcttcctcctgctactctggctcccagataccactggagaaatgtgatgaagcagtctccagccaccctgtctgtgttcnccgaggggaancgccaccctntcctgacgagggccacgtcagagttacgttaatacgcgtacgtagccgttaggaacccaggtacaacgtacgttaaccgtgggaccccaggtaccttccccgaggtccctccgtacctagttccgtaacgtcggttacgcctaacggtaccctaacggcgggaccccttaacgttccggtaacttccccgaggtcccgacggtttacgaaccggtgggaccctaggggttccggttacggcggggtaacacgggttacgtttaccgaccttaccggtactaccgtactacgtaacgcgtaacggttcaccggtacgtagtaccggtagttacgttacgttcgtacgttacgttttaacgttcttacgtacttaggactttaacgggattttaaaccgttaacgtttccgggttacctacggttaaccctttacggttacccgggtttacggggtacccggggtaacggttacgggtaacggggttaacgtaaccgggtttaaaccgaaaccgggtttacgttaaccggggtttaacggttaccgtaaccgggtaccgtttaaccggtacggtttaccggttcgttttaacccg

SEQ ID NO: 175770 - DNA, 620 bp, Homo sapiens
  misc_feature: GYAE6OF02GDYOE.12.23.C01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaancgccaccctctcctgcacgggccagtcagagtgttaatagcgtacttagcctggtaccagcagatacctggccaggctccagctcctnatctatggtcncatctaccgaggccagtggtactccgagcctaggttcaggtcgacgtaggtcgggtactagggactaggtacgtttccacttctaccacctagtaccagcctacgcctgctagtcagtaacgttactttagacttaagttttacttacgtcgtactacgtactaagttaattaaacgttacgttgttacctagtccttacgtaccggtttccggggaccgggggtaacctaggggttacggtaacgtaacggtaacgaaacggttaacgtacggtacggtaccgtacggtaccgaccgtacgttccgttagttacccg

SEQ ID NO: 175771 - DNA, 750 bp, Homo sapiens
  misc_feature: GYAE6OF02HMPDD.12.23.C01.1.454.CMB.1.raw
  modified_base (206)..(206): a, c, t, g, unknown or other
  misc_feature (206)..(206): n is a, c, g, or t
tcagatacgacgtacacgaccggtgctcgattttagtacacgtgattagggattgggggaggaactgctcagttaggacccagacggaaccatggaagccccagcgcagcttctcttcctctgctactctggcctcccagataccactggaagaaatagtgatgaagcagtctccagccaccctgtctgtcgtctccgaggggaanacgccctaccctctcctgcgacgggccagtcaggtagttagttaaatacggacgtaccgttacgtccgttacggtaaccagaccgaagtaacgtcccgtcgggacccaggcccctacccgacggtccctccctactattccgtaggttcggtcgtactacgttacctaacccggcgggtaccctacggtacggttacctacccggaccgtccggttaacggttcgacgggttcggacggttacgggttcggggttaccggtcgggtaaactacgggttaccgtttactaaccctccgtaccgtaaacccgtcgttaaccgaacggccacccggtcgtacgtacgtagttacttaaggtaacttttacgttttgactttaacgttttatacgttccagtaacgtataacgttaattaaccgtcggttttctccgtctacgttccgttaacgggttccggggaccgggtaaggtagggtgtaacgtaacgtaaccggaacgtaggttcggacgttgtaccgtcccgactttacggtccttgttccc

SEQ ID NO: 175772 - DNA, 701 bp, Homo sapiens
  misc_feature: GYAE6OF02GUGR1.12.23.C01.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (314)..(314): a, c, t, g, unknown or other
  misc_feature (314)..(314): n is a, c, g, or t
  modified_base (521)..(521): a, c, t, g, unknown or other
  misc_feature (521)..(521): n is a, c, g, or t
  modified_base (695)..(695): a, c, t, g, unknown or other
  misc_feature (695)..(695): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcgagggccagtcagagtgttaanagcgacttagcctggtaccagcagtactacctggccacggcctaccccgaggtcctcctcacttctagtggnacctatccgtaaccggagggccctaacggttcggtaacctccccggagaccccgttagggttaccaggtcgggcgtacgggttcggggtacgtagggggacctaagggtcgtttaccacttccgtaccaccgtatccgaacgcctaacggcctggacctacggttactagggaagtttcttttggactttaaggttttactttacgnggttactaagtacttaagttaattaaccgtttaaccggtttcgtttaccttacggtacctttaccgggtacgggtttaccggggggaccgggggtaaccgttcggggtaaggaacgtaacggtaacggtaaaccggtgtcgggttacggctacggacctaccgtacttccggtnttaccc

SEQ ID NO: 175773 - DNA, 671 bp, Homo sapiens
  misc_feature: GYAE6OF02GWVJK.12.23.C01.1.454.CMB.1.raw
  modified_base (204)..(204): a, c, t, g, unknown or other
  misc_feature (204)..(204): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (413)..(413): a, c, t, g, unknown or other
  misc_feature (413)..(413): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaanacgccaccctctcctgccgagggccagtcagtagtgttaatagcgacttagcctggtaccagcagataccnggccaggctcccaggtctcctnatctagtggtgcatcctaccgacgggcccaacgtcggtactcccgagcccgtaggttcaggtcgagtaggttgggtctagggactaggtacttcacgtctaccaacccagtcgacncgacgtcctaggcctaggttccgtaaggttaacgtttacgttttcgactttaacgttttagttaacgttcgtacgtacgtacgtaagtttaaattaacgtttaaccgtttcgggttacccttaggtcccttttacgtaccgggttttaccggggggaaccgggggttaaccgaggggttacggtaacgtaactaaaccggtaaaacggtacgttaggtcgggaaccttcggacctaccgtacgttccgttagttaccg

SEQ ID NO: 175774 - DNA, 891 bp, Homo sapiens
  misc_feature: GYAE6OF02IB8V8.12.23.C01.1.454.CMB.1.raw
  modified_base (209)..(209): a, c, t, g, unknown or other
  misc_feature (209)..(209): n is a, c, g, or t
tcagatacgacgtacacgaccggtgctcgatttagtacacgtgattagggattgggggaggaactgctcagttaggacccagacggaaccatggaagccccagcgcagctctcttcctctgctactctggctcccagataccactggaagaaataggtgatgaaagctaagtctccagcccaccctgtcctgtgtctccgaaggggaancgcccaccctctcctgacgagggccctaggtccagtagttgtaaatagcgtaactttaggccttaggtaacccgaggtcaacggactaccgtcgggaccgacggaccttccccagggtcccttaccctacgtaacttccgtaagtcgggtcgacctacgttaccgttaaacccggaccgggtacccaacggtttaccggtaacccgttccccgaacggtacccgtaaacgggttttccgaaggtttcgtacgtaacggggttccggttaccgtacggggtaaccgtaaggtaccggttttacccgaaccttccggttaccaacccgtaaacgtccggtaaacgtccgtaaccggtaccgttacggacccgttaaacggttccgtaaacggtaaacggtttccgtttttacggtacgttttaaaccggtttttaaacgttcccgttaaggttaccgtaaagtaacccgtttaagttaaaacgttaaacggttaacgtttcggtttacccgtttacgtacccgtttaccggtttaaccgggttttaccgggggaaccggggggtaaccttaacgggggtaacggggtaacgttaacgtaaaccggttaaaccggttaacggttcggttaaccggtcggtttaaacggcccttaaaccggtacgtttacctttcggttaaccccg

SEQ ID NO: 175775 - DNA, 809 bp, Homo sapiens
  misc_feature: GYAE6OF02JIQSO.12.23.C01.1.454.CMB.1.raw
  modified_base (205)..(205): a, c, t, g, unknown or other
  misc_feature (205)..(205): n is a, c, g, or t
tcagatacgacgtacacgaccggtgctcgatttagtacacgtgattagggattgggggagggaactgctcagttaggacccagacggaaccatggaagccccagcgcagcttctcttcctcctgctactctggctcccagataccactggaagaaatagtgatgaagcagtctccagcctacctgtctgtctctccgagggaacngcccacctctcctaggcgcgggaccagtcgagaggttcgttaaacgagtacttacgttacgtccgttaggtaccaggaccgaacgacggtaacccgtcgggacccacggtaccccgtacccgtaccgggtacctacccttcgtaacttaccgttaacgtacgtaacgttaacctagtttaccggtaaacgggaaccgggtcccgtaacgtcgggaacctcgtaccgtacgacggtacgacgtaacgttacgtaaggtcgaacgtaggtcgggtacggttacggacgtacgtaccttcgaccgtacctccgtaacccgtcaccgtacgccgtaacgcgtaccggagttaacggttagtttacgttaaacgtttacgtttacgtacgttaacgtaaacgttacggaacgttacgtaaccgtaccggttaccgggtacccttacccggtacggtttacgggtacccggggtaaacggtaaccgggtaacggtacggggtacgtacgggtacgtaaacgggtacccggttaagtacccggggttaggtaccgttaccggtaaccgtacccgttaacggttaccgtttacggttaccgttttaacccgg

SEQ ID NO: 175776 - DNA, 785 bp, Homo sapiens
  misc_feature: GYAE6OF02HQBMU.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgagggaacgacgccaccctctcctgcgacgggccagtcagtagttagttaatagcgtactagtcctaggtaccagcagactaccgtggccacggcctacccgaggtccttcccgtactacgtacgttacgtcggggtacgactaccgttcccgtaacccggtacggggtacccctaacggttacggggttaccctacccccggtaggtacccggttaacgggttacgaacggtcgggtacgtacggggttcggttaccggtaagggaacgtaacgggttacgtttaccgaccgttaccgttacccgaaccgtacgttaccgacgttaccgtaaccggtcccgtaggtaccgttacggttacgtaaacgggtaacgttttacgttacgtacggtttaaacttttttaccgtagttcggttaacacggtacgttaaggtttaactaaacggtttaccgtttcggttacctcgttccgtttacggtaccgggtttaccgggggacggggttaactaggggtacgtaacgtacggtaaccgtaacgtaggttacgtcggtacgtccgaaccttacccgtattccgttacgttacc

SEQ ID NO: 175777 - DNA, 664 bp, Homo sapiens
  misc_feature: GYAE6OF02I6LKA.12.23.C01.1.454.CMB.1.raw
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
  modified_base (469)..(469): a, c, t, g, unknown or other
  misc_feature (469)..(469): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtcgtctccgaaggggaanacgcccaccctctcctgcgacgggccagtcaggagtgttaancgacacgtagcctaggaccagcagactaccngccaggcctccgaggcctcctcactctagtggtcgtctacgtcctaccgagggccctacgtacggtactccccaggccgttacgggttcctaaggtcggacgtagggttcgggtacggtcgggacgtaggtacgttccgactctaccacctactacgacgcacgaccgtagtcgagtacgtagtaacgttnttttagaccttagtttattacgtgttcgacgtaacgtagttaacttaaagttaaccgtttggttaccgtcgttccgtttacgtaaccgggtttcgggggaaccgggggtactaggggtacggtaacgtacgtaaccgtaaacgtccggtacggtacggtacgcgtaccgttaaccgtacttccgttagttacccg

SEQ ID NO: 175778 - DNA, 588 bp, Homo sapiens
  misc_feature: GYAE6OF02H0CQV.12.23.C01.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagttgttaanagcgacttagcctaggtaccagcagatacctggccaggctcccaggcctcctcatctagtggtgcattcaccngggccctatgtactccagccaggttcagtgcngtgggtcngggacagagttccatcctcacctatccgagcagcctgcagtctagaagttatttgtacgttagttttattacttgtactagtcgtagtataataacgtacggtttcctacgcttaccgtacgtttccggggtacgggggtaacctaggggtacggtaacggtaacgtaccgtaaaacggtaaccgttaggtacgtaccgtacggtaccgtaacccgtacttccgttacgttccg

SEQ ID NO: 175779 - DNA, 877 bp, Homo sapiens
  misc_feature: GYAE6OF02JC3WH.12.23.C01.1.454.CMB.1.raw
  modified_base (239)..(239): a, c, t, g, unknown or other
  misc_feature (239)..(239): n is a, c, g, or t
tcagatacgacgtacacgaccggtgctcgatttagtacacgtgattagggattgggggaggaactgctcagttaggacccagacggaaccatggaagccccagcgcagcttctcttccctcctgctactctggctcccagataccactggagaaatagtgatgagtcagtctccacgccaccctgtctgtgtctccgaggggaaagacgccctaccctctcctgcgacggccagtcagngtagttaagacgactacttacgcctacggtaccagcaagtataccgtcggaccgacggtcccttaccccgaggtcccttacccttactacgttacccgttaggttcgggtcctacgtaaccgttacccgtaaccggtaacggggtacccctaaccggtttacgggttaaccccttaccccggaccgggtacccggtttaacgggtttcccgaggttacggggtaccgttaacggggtttcggggtaccgggtttacggggaaaccgtaacgggttacggtttacccgtaacccgttccgtaacccgtaaaccctacgttaccggaacggccctaaacggtccccttaagggcccttaagggttacccgtaaggttaaagttcgtttttacggaactttttaaagggtttttaccctaggttaccctacgtaaacggacctttaaagtttaaacgttaaaccgtttacggtttcggtttacccgtaccggttaacgttacccggttaacgggtttccgggggggaaaccggggttaacgggtaggtggggtaaacttcgggttaaaaccggaaaccgttaggggtttccgggcttaaccgggtccaaccggtacctttacggttccccgttagtttccc

SEQ ID NO: 175780 - DNA, 910 bp, Homo sapiens
  misc_feature: GYAE6OF02G51MP.12.23.C01.1.454.CMB.1.raw
  modified_base (774)..(774): a, c, t, g, unknown or other
  misc_feature (774)..(774): n is a, c, g, or t
tcagatacgacgtacacgaccggtgctcgatttagtacacgtgattagggattgggggaggaactgctcagttaggacccagacggaaccatggaatccccagcgcagcttctcttcctcctgtctactctggctcccagacgaccaccggagaaattgtgttgacgcagtctccaggcacctgtctttatctccgaagggaagagccaccctctccgtgcgacggccagtgaagaattacgtaaacaacgagtactcgtacggtccgtacggtaccgagtacgaacggtaaaccgtcggaccgacggtaccgtccccgacggtacctccccgtactaacgttaccggttaccggtttaacctacccgtaacggaccggtacgggaacccgtaccgtacgggtccaaccgttacccgaacggtaccgtaacggtttcccgaacggtcggtaccgtggggtaccggttacgggttaacgggggacttaaaccggttacctttaaccggtacccttaccggtacctaacccgtaacgttaccaacccgacggttaaccgtacgggtacgggttaaccctaagggttaccgggtttaaactttttccgggaccgtttaaacgggtttagtttaaaccgttttacggttttaaccgtaccggttaacggttaaccgtaaaggtttacggttaaccgggttagggtaccgttccgggttaaaccccgttttacggtttacgggtttttacccgggacggggttaaccgggggttaaccncgggttaaaacgtcgggtaaggtaaaaccggtaggtaaaaccgttcgggtaagtccgggtacccgtaaggtcccctaaacccgtggttttacccgttcggttaacctttaacccgtaccgtttccccgttacccgg

SEQ ID NO: 175781 - DNA, 1038 bp, Homo sapiens
  misc_feature: GYAE6OF02JBUCU.12.23.C01.1.454.CMB.1.raw
  modified_base (207)..(207): a, c, t, g, unknown or other
  misc_feature (207)..(207): n is a, c, g, or t
tcagatacgacgtacacgaccggtgctcgatttagtacacgtgattagggattgggggagaactgctcagttaggacccagacggaaccatgggaagccccagcgcagcttctcttcctcctgctactctggctcccagataccactggagaaatgtgatgaagcagtctccagccaccctgtctgtgtcctaccgaagggggaaanacgcccacccttctcccgtggcgtacggggccaaggttcaaggtagttgttaaatacggccggtaacttaggcccttagggtaacccaggtaccaaggaacttacccgtcgggaccccaacgggtcccctacccgacggggtcccttacccctctaacgttccttaacggttgggtacgcctaagttaccccgtaaacccggaccgggggtaccccttaacggttacggttaacccgtacccccgtaacggtccccggttaagggttttacccggaagggtttaccgggggcccgtttaaagggggggttcggggggtttcccggttaggggggaaaaccttaacggggtacgttttaacccaccgtttacccccgtacccgtaaaaccccgttaaaggtaaacccggacccgttaaacccgggtccccggtttacgggacgtaaccgggtttaccggttaaacgggtaaaaccggttttacggttttttaccgtaaacccgggttttaaggtttttaaaccggttttacggtttacgtttacccggttaacgtacggtttaaaacggtttaaactttaaaacggttttaacccgttttaccgggtttacccgtttcgttacccgtttaacccgggtttaacccggggttttaccgggggggtaacccggggggggtaaacccggtttaagggggttacgggaaccggttaaaccggttaaaccggtaaaaacccgggttacgggtttaccgggttacgggttacccgttaaccgggtaacccgttaacccgttaacggtttacccggtttacggtttcccgtttaacccg

SEQ ID NO: 175782 - DNA, 721 bp, Homo sapiens
  misc_feature: GYAE6OF02FMYHD.12.23.C01.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaanacgccaccctctcctgcacgggccagtcagagttgtaatgacgtacttacgcctgggtaccagcaggtactaccgtggccaggtcctacccgaggtcctccctnacttcctagttcggcgactatcccgacgacgggcctaacgtcggtactcccggacgtaccgtaggttccacgggtcggactagggtggggtccgtaggggaactgggtaactttcccgacgtttacctaccgtaaccacgttccgaacgccgtaacggcccgttagacttacggttctaacggttaagttacgttttacgtaacgtttagtttacgtttacgttagtccgtaagtactagtttaaataacgttacttacgggttactccggttacttacggttaccgggtttacgggggacccgggggttacgtaaaggggtccggttaacgtaaaccgttaaccggaaaccgtaacggtttccgggtaccgacgttaccgggacccttaacgtactttcggttcgtaacccgg

SEQ ID NO: 175783 - DNA, 687 bp, Homo sapiens
  misc_feature: GYAE6OF02HTZAC.12.23.C01.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagatacgacgtacacgaccggtgctcgatttagtacacgtgattagggattgggggagaactgctcagttaggacccagacggaaccatggaagccccagcgcagcttctcttcctcctgctactctggctcccagataccactggaagaaatagtgatgaagcagtcctccagcccacctgtctgtgtctcgaggggaaangcccacctctcctgcgagggccagtcagtagtagttaanagcgacttaggccttaggtaccagaccagtactaccgtggacccagaccttcccaagtacctttctactattctaagtcgctcgacctactccctaccgacgggttacccaacgtgaacctaacctaccccgaaagtaccgtaagggtttccaaggggttccggacgtacgggttggggtacttaggggacctaggtaaccctttcgaccttcgtacctacacgtacctaaccacgtacgtcgactacgtctagattagtagttttcgactttaacttttacgttactactacgacgtactaacttaattaaagttacgttacggtaccgttaccggtacgttaaccgttaaccgtttcggaccgtacgggtaaccgaacggtaccgtaggaacgtaccgtaacgaaaccgttacggtacgttacggtactacggacctaaccg

SEQ ID NO: 175784 - DNA, 587 bp, Homo sapiens
  misc_feature: GYAE6OF02G3NJB.12.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtgtctcgaggggaancgccaccctntcctgcagggccagtcagagtgttaangcgacttagcctggtaccagcagatacctggccaggcctccccgaggcctcctcatctatggtgctatccaccngggcccagtcggtactccccgagtccctaggttcaggtcggcgtaggtgggtctgggacaggtacgttcactctacacctatcacgcgacgcctgcctagtctagtaagttagtttaggtaatttattacttgtacaacgtgacgtagaccgtaacgtcggtcccttacccgtacgtttccgggcgggtaccggaaccgacgggtcgacgtacgtacgaacggtacgtacgtggtcggtacgtcggcctacctagtccgttcgttccttaccg

SEQ ID NO: 175785 - DNA, 805 bp, Homo sapiens
  misc_feature: GYAE6OF02GXT85.12.23.C01.1.454.CMB.1.raw
  modified_base (275)..(275): a, c, t, g, unknown or other
  misc_feature (275)..(275): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagactaccactggagaaatagtgatgaagcagtcctcagccaccctgtctgtgtctccgagggaagcgccaccctctcctgcgagggccagtcagagtgttaatagcacttacgcctacggtaccagcagactaccgnggaccacggcctacccgacggccttcccgtactacttctagttggttacgcctacgtcccgtaaccggacgggtccctacgttcggttaacctccccggacgtaccggtaggttcgaggtcggcgtagggttcgggtcgtagggactaggtacgttcctaccgttcgtaccctaacctacttccgaacgacctaccggtcccgttaggacccgttacgttaggttaaaggttaaacgggtttcgttttacggtaacttttaacggttttttaacgtttaccggtcggttaaccgtaacgttaaccgtttaaaggttttaaattaaaaccggttttacccggtttcgggttttacctacggttaccgtttaacccggggtttacccggggtttaccggggggaacccgggggtaaccgttagggggttacggtaacggttaaccgtaaaccggttaaaccggttacggttagggttcccggaacgtttccggacccggttaacgttccgtttaccggttaccgtttacccg

SEQ ID NO: 175786 - DNA, 728 bp, Homo sapiens
  misc_feature: GYAE6OF02JVLB1.12.23.C01.1.454.CMB.1.raw
  modified_base (202)..(202): a, c, t, g, unknown or other
  misc_feature (202)..(202): n is a, c, g, or t
  modified_base (582)..(582): a, c, t, g, unknown or other
  misc_feature (582)..(582): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctccagataccactggagaaatagtgatgaagcagtctccagccacctgtctgtcgtctcgaaggggaancgccaccgtctccgtgcaggccagtcagagtagttaatagccgtacttagccgtaggtaccagcaagtactaccgtcgggacctacggccctacccgaggccttcctacgtacttcgtagtcggtcgactacgttccgtaaccggacgggtccctaacgtcgggtaaccctccgaacgtcccgtaggttcgaggtcgggacgtagggtcggttacgcgggtaacagtcgttacacttcgtaccgtaacgtacgtacgaccggtctacgtccgtaggacgttacgtacgtacggtaattttacggtttaccgagtttacgttttaactacttcggttacaacggtactaaacgtttactaacgtttaccggtcgtttaccncgtttaccaccggtttaccggtacggggggtaaccggtactaacggggttcgtaaaccggtacgtaaaccgttaacgggtacggtttgggaccggtttacgtaccgtaacccgttaccgggtttatttcccggttaccggttaacc

SEQ ID NO: 175787 - DNA, 814 bp, Homo sapiens
  misc_feature: GYAE6OF02HQFXF.12.23.C01.1.454.CMB.1.raw
  modified_base (209)..(209): a, c, t, g, unknown or other
  misc_feature (209)..(209): n is a, c, g, or t
tcagatacgacgtacacgaccggtgctcgattttagtacacgtgattagggattgggggaggaactgctcagttaggaccagacggaaccatggaagccccagcgcagcttctcttcctcctgctactctggctcccagactaccactggaagaaatagtgatgaagcagtctccagcccacctgtctgtcgtctccgaaggggaaacncgcccacccttctcctgacgaggccagtcagtagttattaatacgacgtacttacgccgtaggtaccacgtacgaagtaccgtaccgtcgggaccgacggtccctacccgtacggtcctacctacgtacttacgttacgttcgggtcgtacctaacttacccgtaccgggacgggtcccttaacggttacgttaacccgtaccccggaacgttccggtaacggtttaccggacgggttaccgggtacgttacggggtttccggggtcggtttaaacgggtaacgttaacggttccgttaccgtaaccttccgtaccgtaaccctattaaccggacgaccgtaccgtctacggaaccttacggtaaccgttaaggtaacgtttacgtttttacggaaacttttaagtttttacgttaacggttcgtaaacgtcggtttaaacttaaacgttaaacgtttaaagttcccggttttccgttacgtacgttaccgttaaccgggttcggttaaccggggggacgtactagggggtactacggtaaacgtaccggtaaacgtgttacgggaccttcgtaccgaaccgtttactaccgttgttacccttcg

SEQ ID NO: 175788 - DNA, 674 bp, Homo sapiens
  misc_feature: GYAE6OF02FPXY6.12.23.C01.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagatacgacgtacacgaccggtgctcgatttagtacacgtgattagggattgggggagaactgctcagttaggaccaagacggaaccatggaagccccagcgcagcttctcttcctcctgctactctggctcccagataccactgganaaatagtgatgaagcagtctcagccaccctgtctgtgtctccaggggaaanacgccaccctctacctgcgaagggccagtcagagtgttaatagcgacttagcctggtaccagcagataccngccagcncccnggctcctnagtctagtggtncatcgaccagggccagtgtactcccacgtcgtaggttcaagtcggctaggtcgggtcgtagggactacggagtttccgaacttcgtacctaaccgtattaccgaggtacctacgacccgtcggacgtaacgttccgtaggtaaggttattttacggacgttaacgtttttaagttacgtttacgtacaaggtacttaagttaattaaacgttaactttcgggtttacctacgtctaccttacgggtttccggggaccgggggtaacccgtagggtacggtaggtaaccggtaaccgtaaaaccgtaaccggttacggttacgggtaccgttacggacccgtaaccctacgttacccgttacggtttacccg

SEQ ID NO: 175789 - DNA, 757 bp, Homo sapiens
  misc_feature: GYAE6OF02IGKT2.12.23.C01.1.454.CMB.1.raw
  modified_base (189)..(189): a, c, t, g, unknown or other
  misc_feature (189)..(189): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaaatagtgatgaagcagtctccagccacctgtctgtntcctcgaggggaacacgccaccctctcctgcgacgggccacgtacagtagttagttaatacgacgtaccgttagccttaggtaaccagaccagtaacttaccgtcggaccaggcctcccgaggtccctcctactacttcgttagtggtcgactacttccgaaccgtggaccctacgtggtacctacccgacgtccggttacggtctacggtcggacgtaggggtggttaccggtgggaactacggtactttccgaccttcgacctacgtacgtacgtacgtcgacgtccgtacggacgtaccggttacgtaacggttaaacgtttagtttttacggtacgtttaaacgtttttaacgttacgtttccgtaacgttgtaacgttaaacgtttaaacgtttaaacgtaccgttttacggtttccgtacgtttccgttaccgggttaacgggtttaccggggggtacggggtaacccgtaggggtaccggtaacgtaacggttaacccgtaaaggtacgggttacgtacgggtacctacggaccgttaccgtaacgttccgttagttcccg

SEQ ID NO: 175790 - DNA, 655 bp, Homo sapiens
  misc_feature: GYAE6OF02G8B83.12.23.C01.1.454.CMB.1.raw
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (497)..(497): a, c, t, g, unknown or other
  misc_feature (497)..(497): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccatggagaaatagtgatgaagcagtctcagccacctgtctgtcgtcaccgaggggaaanagcccaccctctcctggacgacgggcctagtcagtaggtgttaaagcgcgtacttacgccgtggtaaccngcaagtctaccgtggccaggccttacccgaggtccctacctgtaactcgtatgggtcactatcctaccgnggcctagtcgtctacccgagtacccgtggttcaggtaccgtgtacgggtcggttcgaggacgtacggtacgttccaacttccgacctaaccgatcgtaacgcgactccgtagcctagttccgaagttacgtatttcgacgtagttttactagtntacgtagacttaacgtaattaacggtacgtttgttccgtacgtaccgttacgtaccgggttaggggaccggggttaatacgggtagtacgtaacgggttaaaccaaggtaaccggtgtacggtaccgtacaacccggtcttaaggttcctcggttacc

SEQ ID NO: 175791 - DNA, 834 bp, Homo sapiens
  misc_feature: GYAE6OF02I3N3R.12.23.C01.1.454.CMB.1.raw
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatgtgatgaagcagtctcagccaccgtgtctgtgtctccgaagggaaacgcgacccacccttcgtccgtgacgtacgggcctagttcaaggtagttcggttaacgcctaacccttaacgttcgcccgttaaggtaaccccaaacgaacggtaaaacccgtcgggacccgtaacgggtcccttaccccgacgggtcccttaccccgtacgttaccgttacgttactacggttacgtacgtaccgtaacgttaaacccggaaaaaccggggtccctaaccggtaccgggtaacctaaccgtacccccggtacggtaccccgttaacgggttaacccgtacggtaccggtaccgttaacggggttcgggttaccggtcggggggtaactaccgggttaccgttaccttaacccgttccggtaaacccctacgttaccgacccgttacgggacccgtaacgtacccggtaacggtaacgtcccgggtaagtaacggtttacgtttaacgtacgttaacttttacgtacgttcgttacgaccgtcgtacggtacgtacgtacgtaccgtcgtcgttacgttcgttcggttcggaccggtaacggcggtacgtacgtacggtaacgacgtaaccggtacgtaacgtcggaccgtacgaccggtaccttacaccgtccgttcgtaccg

SEQ ID NO: 175792 - DNA, 629 bp, Homo sapiens
  misc_feature: GYAE6OF02F939C.12.23.C01.1.454.CMB.1.raw
  modified_base (164)..(164): a, c, t, g, unknown or other
  misc_feature (164)..(164): n is a, c, g, or t
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (479)..(479): a, c, t, g, unknown or other
  misc_feature (479)..(479): n is a, c, g, or t
  modified_base (622)..(622): a, c, t, g, unknown or other
  misc_feature (622)..(622): n is a, c, g, or t
tcagatacgacgtacacgaccggtgctcgatttagtacacgtgattagggattgggggagaactgctcagttaggacccagacggaaccatggaagccccagcgcagcttctcttcctcctgctactctggcctcccagataccactggagaaatgtgatgaancagtctcngccacctgtctgtgtctcgagggaancgcccacctctcctgcagggccaggtcagtcgtagttaangcgtacttagccgtaggtaccagcagactccgtggccaggcctacccgaggtcctccgtnacttcgtagtcggtacnctactccgaccggagggtccctaggttcggtacctaccccgaggtcccgtaaggtttccaggtcggacgtacggttcgggctagggacctaggtacgttcacgtttcactactagtcgagcacggtctgccgtagttcgtagtagttcgtttcgaattagtttntacgttgtactagtactaagttaactaagttccgttcgttctgtccgttacggttacggttccggggacgggtactagggtacgtaacgtacgtaaccgtaacgttccgtaggttcgaccgttcgaccgtacttcggttcgtntttaccg

SEQ ID NO: 175793 - DNA, 757 bp, Homo sapiens
  misc_feature: GYAE6OF02JHYB6.12.23.C01.1.454.CMB.1.raw
  modified_base (156)..(156): a, c, t, g, unknown or other
  misc_feature (156)..(156): n is a, c, g, or t
  modified_base (489)..(489): a, c, t, g, unknown or other
  misc_feature (489)..(489): n is a, c, g, or t
tcagatacgacgtacacgaccggtgctcgatttagtacacgtgattagggattgggggaggaactgctcagttaggacccagacggaaccatggaagccccagcgcagcttctcttcctcctgctacctctggctcccgagattacccactggganaatagtgatagaagctagctccagccaccctgtctcgtgtcctaccgaaggggaaacacgcccacccgtctccgtagcgacgggcacggtcgagtagttacgttaatcggctacttacgccttaggttaaccacgcaacgtagttaacctggacctacggtaccctcccgtacgcctaccgttcaattccgtcgtggtcgacctgtacccaccggcgaccctacttggtatccgctagacctggtttacacggggtatcggtaggttcgggacttacgggaaccgtagtgtttaccactttcccgaatttacgacgtacacgacacgcgtacncggtactagtacgtaacgtttctttaaacggtccgttttaagtttaccgttacgttacgttacgtaacggtactaaacgtttaacgtaacgtttaacctttaccgttacggtttcgttaacccggttacggtttaccgggttaacggggaacccggggttaacggtacgggtacgtaacggtaaaccggttaacggtaaaacccgtcgttacgggttaacgtacggttaccgtaacccggtaccgtttaccggttacgttttaaccgg

SEQ ID NO: 175794 - DNA, 776 bp, Homo sapiens
  misc_feature: GYAE6OF02JSGPG.12.23.C01.1.454.CMB.1.raw
  modified_base (208)..(208): a, c, t, g, unknown or other
  misc_feature (208)..(208): n is a, c, g, or t
  modified_base (352)..(352): a, c, t, g, unknown or other
  misc_feature (352)..(352): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagccagtctccagcctaccctgtctgtcgtcaccgagggggaaancggcccaccctctccgtagcgaagggccctagtaccgaggtaaggttagttaactacgggtccgtaacgttttacggcccctttgggtaaccccaggtacctaggaacttacccggttcgggacccgtagggccttaccccggngggccctttccactactacgtctgggtcactacgtccgtaccgaacgggtcccacggttcggtaactccccgtaacgcccgttaagggtccgaagggtcggtacgtggggtttacgggtccggtacggggtaccgtaaggttccgggttacctaacttttccgaaccctaccgtacgtccggttaccgcgtacccgtccgtacgtaccgtacgttcgtaacgtaagtttaccgttgtacggttatttaacgttctacggtctacgtaacgtagtacttaacgttaacgttcggttacctagtcctttcgtaccggggtttccgggacggggttcctacgggtaggtaacgtaacgggtaaccttaacggtaggttcggtacgttaccggttacgaccgttaaccgtcgtttactaggtttaccc

SEQ ID NO: 175795 - DNA, 721 bp, Homo sapiens
  misc_feature: GYAE6OF02JN4E3.12.23.C01.1.454.CMB.1.raw
  modified_base (209)..(209): a, c, t, g, unknown or other
  misc_feature (209)..(209): n is a, c, g, or t
  modified_base (449)..(449): a, c, t, g, unknown or other
  misc_feature (449)..(449): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagcccaccctgtctgtcgtccgtccgaaggggaaancgccctaccctcgtcctaggcgacgggacctacggtcgaagagttagttaaactcggacgtacgttacgcctaggtaccagcgaagtactaccgtcggccgacggcctcccgacggtcctcctacgtaactcgttacgtggtcgtacctacgttacctaccggacggtcctacgtacggtaactcccgacgtaccgtcggttaccaggttcgacggtagggtacggttcgacggtaacgngggtttaccgtcctaaccgtccgtaccctaccgtacgttacccgaacctacgggacctaacgggtccttaaccggtggttaaacgtttaacgtttaacgggtttaaattttacgttacgtacgttaacgaccgtaactggtacctaccgtaacgtccgtccccgttaacgtcggtaccgggtacggaacggaacgttaggtacgtacgaactacgacggacgtacggtgacgaccgttcgactaactcgtcgtacgttcttaccgcttcccg

SEQ ID NO: 175796 - DNA, 666 bp, Homo sapiens
  misc_feature: GYAE6OF02GT7C4.12.23.C01.1.454.CMB.1.raw
  modified_base (242)..(242): a, c, t, g, unknown or other
  misc_feature (242)..(242): n is a, c, g, or t
  modified_base (475)..(475): a, c, t, g, unknown or other
  misc_feature (475)..(475): n is a, c, g, or t
  modified_base (564)..(564): a, c, t, g, unknown or other
  misc_feature (564)..(564): n is a, c, g, or t
tcagatacgacgtacacgaccggtgctcgatttagtacacgtgattagggattggggggaggaactgctcagttaggacccagacggaaccatggaagccccagcgcagcttctcttcctcctgctactctggctcccagataccactggagaaatgtgatgaagcagtctccagccacctgtctgtcgtctccgaggggaaagacgccaccctctcctgcgaggccagtcagagtgttaanagcgtacttagccgtaggtaccagacagtactaccgtcggccaggccctacccgaggtcctccctacacttcgtagtggttacgactacgttaccgtaccggacggccctacgttacggtacctccccgaacgtccggtaggttccaggttcggacgttaggggttcgggtacgtcgggaactaggttacgtcctaccgtctaccgacctacgtcacgacgacgtccgtacgngtagttgtaagtagttacgtttgtaagtttacgtttacgttaccgttggtactagtattaacgttaactaacgttacgtttcgtttacncggttacttccgggttacggtacggggacgggtaacgtagggtacgtaacgtacgtaacggaacgtaggcggtacgtcgcggtacccagtcgttctgttccc

SEQ ID NO: 175797 - DNA, 757 bp, Homo sapiens
  misc_feature: GYAE6OF02HRD93.12.23.C01.1.454.CMB.1.raw
  modified_base (206)..(206): a, c, t, g, unknown or other
  misc_feature (206)..(206): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggaagaatagtgatgaagcagtctccagccaccctgtctgtcgtctaccgaggggaaancgcccacctctcctgcgaggccagtcagagtgttaatgacgtacttagccgtggtaccagcagactaccgtggaccaggcctcccgaaggcccgttcctacgtaattaccgttagttcgggtactacgtacttaccctaccggtaacgggccctaaccggttacggttacctacccgacgacccgttaacggttctacggtcgggtacgtagggttcggggttacggtacgggacgtaacggtacgtttcccgtaaccttccgtaacccaaccgtacgtaccgtaacgccgtaacggtcccctggtaaccgtacggtttactaacgggttaagtttcgttttacgtacgttttacgttttacgttacgtttcacgtaactacgtaacgtttaaattaacggttaccgtttacgttcccgtagttcccgtttaacggtccgggtttaccggggggaacgggtaccggttaaggtacgggtaacgtaacgtaaccggtaaacgttacggtaggtcgaccggttcgaaccttaccgtgttaccctgtttacccg

SEQ ID NO: 175798 - DNA, 868 bp, Homo sapiens
  misc_feature: GYAE6OF02HHXI0.12.23.C01.1.454.CMB.1.raw
  modified_base (210)..(210): a, c, t, g, unknown or other
  misc_feature (210)..(210): n is a, c, g, or t
  modified_base (446)..(446): a, c, t, g, unknown or other
  misc_feature (446)..(446): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggcctcccagactaccactggaacgaaatagtgaatgaagcatctcagcccacctgtctgtcgtcaccggaaggggaaanacgccaccctctaccgtgccgagggaccagtcgaagtacgttagttaaacaggtactaccttacggaccgtcggtaaacgacgacgtaagaacgtaccgtacgggaccctaacgggtcctacccggacgggtcctacctacgtactacgtaacgttcgggtacactacgtaccgtaaccgacgggacctacggtcgtaactcccgaacgtcgaacggttaccgagttcggaaccgngggttacgggtatacggggacacggtacgttaccacgttctacccgtaacgtacgtacgacgtaccggtacgtccggttaagacccgttacggtacgttaacgggtaaactttaagggttttacggtaaccgttttaaacggtttttaactacggtttaacggtaaccttaaagggtcccttaaaaagttaaaccgtttaaaacgtttaccggtttaaccgttacggttaaccgttaacccgtttaacgggtttaacccgggtttaaccgggggggaacggggtttaaacccgggtaaagggttaccgggtaaaacggttttaaaccgggtaaacccgttaaaaacgggttccgttaacgggttacggttaccgtaacggttaaccccaaccggtttaacgtttacccggtagttttaaccc

SEQ ID NO: 175799 - DNA, 857 bp, Homo sapiens
  misc_feature: GYAE6OF02HGBDK.12.23.C01.1.454.CMB.1.raw
  modified_base (214)..(214): a, c, t, g, unknown or other
  misc_feature (214)..(214): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagactaccactggagaaatagtgaagtagaacgcacgtctccagcccaccctgtctgtcgtctccggaaggggaacncgcccctaccctcctcgtcgaccgacgggccgagtacgagtagttagttaagacgtacgtacttacggccgtcggttaccacggtacacgtaccgttaccggtacggaccggacgtccccgtacccggaacggtccctaccctactcttacgttaacggttcggtacgtccgttaactcccggttaaccgcgggtaaccctacggttcgtacccgttaccgaccgtaccgttccggtcgtacggtacggtcggtacggttcgggtacgtagggtaacgtacggttacgttaccgaccgttcgaacctaccgtacgtaccgaccgtacgtaccgtaccgcgtacgtacggtactacggttaagttaccgtttagttacgtttaacgttttacggttacttaggtaaccgtagttaacgttaacgtaaacgtttaaccggttaacgttttaccgggttacccttaacgttcccgttttacccgggttaccggggttaccgggggtaccgggttaaccgggttaacgggggtactttaaccgggtaaccgttaaaccggtaaacccggttaacgggttccggttaacgggaccttaccgggaaccccgttaccggtttaacgttcccggtttacggtttaaccccg

SEQ ID NO: 175800 - DNA, 689 bp, Homo sapiens
  misc_feature: GYAE6OF02GTCN8.12.23.C01.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (678)..(678): a, c, t, g, unknown or other
  misc_feature (678)..(678): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggcctcccagataccactggagaaatagtgatgaagcagtctccagccaccctgtctgtntctccgaaggggaancgccaccctctcctgcgagggccagtcagagtagttaanagcgacttagcctggtaccagcagactaccgtggccaggccctacccgaggtccttaccctcgtacttccttaagtcgggttgacctagttacccgaccggacgggacctaaccgttcgggttaacctcccccgaggtcccttagggttaccaggttcgggacctaagggttcggggttacctacggggactaggtacgtttccaacgtccgtacaacctatacgacgccaggtccccgtagtccgtaacggtcttaagggtaacgttacttttcggaactttaagttttactacgttgtactagtagtaaacgttaagtaacgttacgttcgttactcgtcgttacgttacgggttccgggggacgggtaactagggtacggtacgtaacctaaggtaaccgtaggttcgtaaccgcgtacgacctaccggtntccgtagttcc

SEQ ID NO: 175801 - DNA, 736 bp, Homo sapiens
  misc_feature: GYAE6OF02I52V7.12.23.C01.1.454.CMB.1.raw
  modified_base (211)..(211): a, c, t, g, unknown or other
  misc_feature (211)..(211): n is a, c, g, or t
  modified_base (508)..(508): a, c, t, g, unknown or other
  misc_feature (508)..(508): n is a, c, g, or t
tcagatacgacgtacacgaccggtgctcgatttagtacacgtgattagggattgggggaggaactgctcagttaggacccagacggaaccatggaagccccagcgcagcttctcttcctcctgcctactctggctcccagtataccacgtggaagaaatgtgatgaagcagtctccagcccacctgtctgtcgtactaccgaaggggaaanacggtcccaaccgtctccgtagccggacgggcctagtcgaagtagtacgttaagaggaccggttacttacggccttacgggtaccagacgaagtactaccgtcggacccgaggaccccttccccggaaggtcccttaccgtactaattaccgtacggttcggtacgtactaacgttccgtaaccggacgggtaccgtaccttacgggtacctcccgaaggtcccgttaagtccgtaggcggtacgtacgggtcggttcgaggaactaggtcttacgacttccgcgtaactcgtaccncgacgtccgtacctggacgtacgtcgtagtaacgttcttacgatttacggtttattcgtagtacgacttgtaaagttacgtaaacttcgttacggttactcgtcccgtttacgggttccggtacgggggttaaccgggtacgtagggtaacgtaccggtaagttaaccgacggtaaacccgttgggtaaccgtcgacgtaccggttaccttacggttactccggttac

SEQ ID NO: 175802 - DNA, 940 bp, Homo sapiens
  misc_feature: GYAE6OF02FXNJA.12.23.C01.1.454.CMB.1.raw
  modified_base (163)..(163): a, c, t, g, unknown or other
  misc_feature (163)..(163): n is a, c, g, or t
  modified_base (169)..(169): a, c, t, g, unknown or other
  misc_feature (169)..(169): n is a, c, g, or t
tcagatacgacgtacacgaccggtgctcgatttagtacacgtgattagggattgggggagaactgctcagttaggacccagacggaaccatggaagccccagcgcagcttctcttcctctgctactctggctcccagactaccactggagaaatgtagatgancagtcncagccaccctgtcctgtcgtactccggaagggaacgtcgaccctacccttctccgtaggaccgtacggggtccaacggttacgaacggttaggttacgtttaaacgtacgggtaccgttaaacttttaccgggaccccttttaggggtaacccgtaacgggtccgtaaaaggttaaccggtaaccccgttagggggacccctaaaggggtccccttacccccggaggggttacccccttaccccttacgtaacttccggttaacggttcgggggtacgtacctaaccgttacccgtacccgggacgggtacccgtaacgttcgggtaacttccccgacggttccggtaaccggttcggacggttccggcgtaacggggttggggtacgggtttaccggggaacgtttaccggacgtttacctaccggttactacccgaccgttactacgaacgtaccacgtcccggtacgtacgtacgtaccgttaacggtacgtttcgttaacggtttaacgtttaacgttttacttaccttacgggttaacctagttaacttaaagtttaaaccgttaacttttaacgggttcccgtttaaccggtacttccgttttacccggttacgggggttccgggggaacccggggtttacttaaccggggtagggttaaaccgtaccggaaacgggttaaacccggtggttttaacgggtttaccgaaccggttttccgaaacccgtaacgggttttacgtttacccgttaggtttaacccccg

SEQ ID NO: 175803 - DNA, 763 bp, Homo sapiens
  misc_feature: GYAE6OF02JGSLY.12.23.C01.1.454.CMB.1.raw
  modified_base (207)..(207): a, c, t, g, unknown or other
  misc_feature (207)..(207): n is a, c, g, or t
tcagatacgacgtacacgaccggtgctcgatttagtacacgtgattagggattgggggaggaactgctcagttaggacccagacggaaccatggaagccccagcgcagcttctctcctcctgctactctggctccagactaccactggagaaatagtgatgaagcagtctccagccaccctagtctgtgtccgtccgaaggggaaancgcccacccttctcctgcgagggaccagtcagtatacgttaaagtagaccgtaacgttacgcccgttagggaaccctaggacctaaggtaacttccgtggacccctaggccgtccccgtaggccttcccctataactcgtagtcggtcgcctaagtcctaaccggacgggtcccctgttaacggtacccttaccccggaaggtccgtaaggttccgaggtccgggtccgttaggttcccggggtcggacgggattaacggtcgtttaccaaccgtcctgaaacccctgtccgacgtacgtacgacgtacgcgtaaggtcgtagttaaaggttactttacggttaaccgtttaagtttaagttaccgtagttacgtacgtaacttaaacgttaacgtaacgtttaaaccgttcgggttccttaacgtcctttacgggtacccggtttacggggggaaccgggttacgtacggggtaggtaacggttaacgtaaccggtaaaacgttccggtaggtacccgtggtacccgtaccgtacgtacgtttccgtagttaccg

SEQ ID NO: 175804 - DNA, 627 bp, Homo sapiens
  misc_feature: GYAE6OF02FLDH5.12.23.C01.1.454.CMB.1.raw
  modified_base (204)..(204): a, c, t, g, unknown or other
  misc_feature (204)..(204): n is a, c, g, or t
tcagatacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccgaggggaaangccaccctctcctgcagggccagtcagagtgttaatagcgtacttagcctggtaccagcagatacctggccaggcctcccgaggctcctcatctagtcggtcgcatcctaccgacgggcccacgttcggtaactcccgacgccgtacggttccaggtcggcgtacgggtgggtacgtgggacaggtacgttctactctaccacatacgagcacgtcctagctgtcgtagtaacttacgtttagtacgttagtttacttacgttcgtacagtacgtaacgttaagttaaacttacgtttcggttaccttcgtccgttacgttaccgggtttacggggaccggggtaacgttagggtaggtaacgtaacgtaaccggaaacggtagtcggtaggtacgtacgtcctacgtacgttcgttgttacc

SEQ ID NO: 175805 - DNA, 559 bp, Homo sapiens
  misc_feature: GYAE6OF01AS2JE.25.12.B01.1.454.CMB.1.raw
  modified_base (546)..(559): a, c, t, g, unknown or other
  misc_feature (546)..(559): n is a, c, g, or t
tcagactgtacagtcacgaccggtgctcgatttagtagtgtagattcggggctgccctttggctttggagattggttttctcgagtgggggctggagtggctttcatacattagtggaagtggtcatgacattaactacgcagactctgtgaagggccgattcaccatctccagggacaacgccaggaactccctctatctgcgactgagcaaccgtgagagtcgaagacacggtcctatttactactgtaccgacacgacccccgagatgtcgaccgtccgtcggggcccggacctcggtcctccgtcctcctcacgccctaccgaaccgaaccggccctacgttcccggttccccttcccccgtcggaccccacccctccctacccgaacggaccgccgtaacccgtcggtcgggggaccaccggccggcccgggtccccgtcgggccttacggccgttacgggtacgaacggtaccttaccgttaccacgttcgtaccgtaggtcgtgggacggcgggtcgtcggacgaacgggcgacagagnnnnnnnnnnnnnn

SEQ ID NO: 175806 - DNA, 445 bp, Homo sapiens
  misc_feature: GYAE6OF01C6W16.25.12.B01.1.454.CMB.1.raw
  modified_base (439)..(445): a, c, t, g, unknown or other
  misc_feature (439)..(445): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacagacccccgagatgtgactcctggggcccgggaaccctggtctccgtctcctcagcctccaccaagggcccatcggtcttcccctggcaccctcctccaagagcacctctgggggcacagcggccctgggctgcctggtcaaggactacttccactgtacagtctgagcgggctggcaaggcgcatagnnnnnnn

SEQ ID NO: 175807 - DNA, 282 bp, Homo sapiens
  misc_feature: GYAE6OF01BX1VC.25.12.B01.1.454.CMB.1.raw
  modified_base (263)..(282): a, c, t, g, unknown or other
  misc_feature (263)..(282): n is a, c, g, or t
tcagactgtacagtcacgaccggtgctcgatttagtagtgtagatttcggtcgggggagatactagtggttatttcgattactactttccctactgggccagggttccctggtcaccgtctcctcagcctccaccaagggcccatcggtcttcccctggcgccctgcctccaggagccacctccgagagcacagcggccctgggctgcctggtcaaggactacttccactgtacagtctgagcgggctggcaaggcgcatagnnnnnnnnnnnnnnnnnnnn

SEQ ID NO: 175808 - DNA, 512 bp, Homo sapiens
  misc_feature: GYAE6OF01DRB79.25.12.B01.1.454.CMB.1.raw
  modified_base (345)..(345): a, c, t, g, unknown or other
  misc_feature (345)..(345): n is a, c, g, or t
  modified_base (476)..(477): a, c, t, g, unknown or other
  misc_feature (476)..(477): n is a, c, g, or t
  modified_base (479)..(479): a, c, t, g, unknown or other
  misc_feature (479)..(479): n is a, c, g, or t
  modified_base (481)..(482): a, c, t, g, unknown or other
  misc_feature (481)..(482): n is a, c, g, or t
  modified_base (484)..(484): a, c, t, g, unknown or other
  misc_feature (484)..(484): n is a, c, g, or t
  modified_base (486)..(495): a, c, t, g, unknown or other
  misc_feature (486)..(495): n is a, c, g, or t
  modified_base (497)..(503): a, c, t, g, unknown or other
  misc_feature (497)..(503): n is a, c, g, or t
  modified_base (505)..(508): a, c, t, g, unknown or other
  misc_feature (505)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagactgtacagtcacgaccggtgctcgatttagtagtgtagattcggggctggccctttggctttggagatggttttcgtcgatgggggctggagtggctttcatacattagtggaagtggtcatgacattaactacgcagactctgtgaagggccattcaccatctccgagggacaacgccaggaagtccctctatctgcgactcgagcaacctgaggacgtcgaagacacggccatttactactgtacgacagacccccgagatgtgacctccgtggggcccgggaacctggtctccgtctcctcacgcctccacacgggccctacgtcggtcttcccccnggcccaccctcctccaagcgcacctcgtggggccacgacgccggcccgtgggctgcctggtcaacggtactacgttccacgtcgtacctagtctgacgtcgggctgggccaacgggccgcaagtgctgcgnngngnngntnnnnnnnnnngnnnnnnntnnnngngn

SEQ ID NO: 175809 - DNA, 453 bp, Homo sapiens
  misc_feature: GYAE6OF01CLLSB.25.12.B01.1.454.CMB.1.raw
  modified_base (194)..(194): a, c, t, g, unknown or other
  misc_feature (194)..(194): n is a, c, g, or t
  modified_base (445)..(453): a, c, t, g, unknown or other
  misc_feature (445)..(453): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctntatctgcgactgagcaacctgagagtcgaagacacggccatttactactgtacgacacgaccccgagatgtgactcctggggcccgggaaccctggtctccgtctcctcagcctccaccaaggcccatccggtcttcccctggcaccctcctccaagacgcacctcgtgggggcacgacgccggccctgggctcgcctggtcaaggactacttccactgtacagtctgagcggctggcaagggcgcatagnnnnnnnnn

SEQ ID NO: 175810 - DNA, 439 bp, Homo sapiens
  misc_feature: GYAE6OF01CNX3H.25.12.B01.1.454.CMB.1.raw
  modified_base (435)..(439): a, c, t, g, unknown or other
  misc_feature (435)..(439): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaaacgccaggaagtccctctatctgcgactgagcaaacctgagagtcgaagacacggccatttactactgtacgacagacccccgagatgtgactcctggggcccggaaccctggtctccgtctcctcagcctccaccaaggcccatcggtcttcccctggccaccctcctccaagagcacctctggggcacagcgccctgggctgcctggtcaaggctacttccactgtacagtctgagcggctggcaaggcgcatgnnnnn

SEQ ID NO: 175811 - DNA, 558 bp, Homo sapiens
  misc_feature: GYAE6OF01EM374.25.12.B01.1.454.CMB.1.raw
  modified_base (528)..(558): a, c, t, g, unknown or other
  misc_feature (528)..(558): n is a, c, g, or t
tcagactgtacagtcacgaccggtgctcgatttagtagtgtagattcggggctgccctttggctttggagatggttttctcgatggggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacacgaccccgagatgtgactccgtcggggcccgggaaccctggtcctccgtctcctcacgccctccaccgaacgggccccagttccggtcccttcccccctcggccaccccttcctaccaacgacgccacctcgtgggggccacacggccggcccgtgggctcgccgtcggtacgaacggtacctacttacccacgttacggtaacctaggttaccgttgggacgggtccggggacgttcggggaccgtaacgggggcccgtacgaacgttagcgagnnnnnnnnnnnnnnnnnnnnnnnnnnnnnnn

SEQ ID NO: 175812 - DNA, 543 bp, Homo sapiens
  misc_feature: GYAE6OF01A0NND.25.12.B01.1.454.CMB.1.raw
  modified_base (516)..(517): a, c, t, g, unknown or other
  misc_feature (516)..(517): n is a, c, g, or t
  modified_base (519)..(543): a, c, t, g, unknown or other
  misc_feature (519)..(543): n is a, c, g, or t
tcagactgtacagtcacgaccggtgctcgatttagtagtgtagattcggggctgccctttggctttggagatggttttctcgatgggggctggagtggctttcatacattagtggaagtgtcatgacattaactacgcagactctgtgaagggccgattcaccatctccagggacaacgccaggaagtccctctatctgcgactgagcaacctgagagtcgaagacacggcctaatttacactgtacgacacgacccccgagatgtgacctccgtcggggcccgggaaccctggtctccgtctcctcacgccctccaccgaacggcccctacgtccggtcctttcccccgtcggcccaccccgtccctcccgaacgacgcccacccgtcgtcgggggcaacgacggccggccccgtggggcctcggccgtgggtacaacggtaccttaccgtttcccacgttcgtaccacgttcgtaggacggcgggtcgcgggtacgaacgggcgccgaatcggnngnnnnnnnnnnnnnnnnnnnnnnnnn

SEQ ID NO: 175813 - DNA, 549 bp, Homo sapiens
  misc_feature: GYAE6OF01BKEHO.25.12.B01.1.454.CMB.1.raw
  modified_base (313)..(313): a, c, t, g, unknown or other
  misc_feature (313)..(313): n is a, c, g, or t
  modified_base (519)..(519): a, c, t, g, unknown or other
  misc_feature (519)..(519): n is a, c, g, or t
  modified_base (521)..(549): a, c, t, g, unknown or other
  misc_feature (521)..(549): n is a, c, g, or t
tcagactgtacagtcacgaccggtgctcgatttagtagtgtagattcgggggctgccctttggctttggagatggtttttctcgatgggggctggagtggctttcatacattagtggaagtggtcatgacattaactacgcagactctgtgaagggccgattcaccatctccagggacaacgccaggaagtccctctatctgcgactgagcaacctgagagtacgaagacacggctactttactactgtacgacacgaccccgacgatgtcgactccgtcggggccccggaacctcggtctccgtcctcctcncgtccctccaaccgaacggcccacgtccgtcccttccccgtcggccacccctcctaccgaacgcgccaccgtcggtcggggccacgacggccggcccgtgggccgtcggtccgtggtacgaacgaccttacttccactggtaacccagtcgtacgggacggcgggttccgaggggacccaacggggccgtaacgaagtacgtgcgngnnnnnnnnnnnnnnnnnnnnnnnnnnnnn

SEQ ID NO: 175814 - DNA, 447 bp, Homo sapiens
  misc_feature: GYAE6OF02INMCD.25.12.B01.1.454.CMB.1.raw
  modified_base (412)..(412): a, c, t, g, unknown or other
  misc_feature (412)..(412): n is a, c, g, or t
  modified_base (440)..(447): a, c, t, g, unknown or other
  misc_feature (440)..(447): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacagacccccgagatgtgactcctggggcccgggaaccctggtctccgtctcctcagcctccaccaagggcccatcggtcttccccctggcaccctcctccaagagcacctctgggggcacagcggccctgggctgcctggtcaaggactacttccactgtacngtctgagcgggctggcaaggcgcatagnnnnnnnn

SEQ ID NO: 175815 - DNA, 446 bp, Homo sapiens
  misc_feature: GYAE6OF02GH29X.25.12.B01.1.454.CMB.1.raw
  modified_base (440)..(446): a, c, t, g, unknown or other
  misc_feature (440)..(446): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacagacccccgagatgtgactcctggggcccgggaaccctggtctccgtctcctcagcctccaccaagggcccatcggtcttccccctggccaccctcctccaagagcacctctgggggcacagcggccctgggctgcctggtcaaggactacttccactgtacagtctgagcgggctggcaggcgcatagnnnnnnn

SEQ ID NO: 175816 - DNA, 455 bp, Homo sapiens
  misc_feature: GYAE6OF02JQ3KY.25.12.B01.1.454.CMB.1.raw
  modified_base (363)..(363): a, c, t, g, unknown or other
  misc_feature (363)..(363): n is a, c, g, or t
  modified_base (435)..(435): a, c, t, g, unknown or other
  misc_feature (435)..(435): n is a, c, g, or t
  modified_base (441)..(455): a, c, t, g, unknown or other
  misc_feature (441)..(455): n is a, c, g, or t
tcagactgtacagtcacgaccggtgctcgatttagtagtgtagattcggggctgccctttggctttggagatggttttctcgatggggggctggagtggctttcatacattagtggaagtggtcatgacattaactacgcagactctgtgaagggccgattcaccatctccagggacaacgccaggaagtccctctatctgcgactgagcaaacctgagagtcgaagacacggccatttactactgtacgacagacccccgacgatgtgactcctggggccccgggaaccctggtctccgtctcctcagcctccaccaagggcccatcggtctccccctggccaccctcctccaagagcaccnctgggggcacagcggccctgggctgctggtcaggactactccactgtacagtctgagcgggctggcaaggcncatagnnnnnnnnnnnnnnn

SEQ ID NO: 175817 - DNA, 453 bp, Homo sapiens
  misc_feature: GYAE6OF02F82T0.25.12.B01.1.454.CMB.1.raw
  modified_base (409)..(409): a, c, t, g, unknown or other
  misc_feature (409)..(409): n is a, c, g, or t
  modified_base (436)..(453): a, c, t, g, unknown or other
  misc_feature (436)..(453): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacagacccccgagatgtgactcctggggcccgggaaccctggtctccgtctcctcagcctcaccaaggcccatcggtcttccccctggcaccctcctccaagacgcacctctgggggcacagcggccctgggctgcctggtcaaggactactcactgtacngtctgagcgggctggcaggcgcatagnnnnnnnnnnnnnnnnnn

SEQ ID NO: 175818 - DNA, 455 bp, Homo sapiens
  misc_feature: GYAE6OF02JA82S.25.12.B01.1.454.CMB.1.raw
  modified_base (446)..(455): a, c, t, g, unknown or other
  misc_feature (446)..(455): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacacgacccccgacgatgtgactcctggggccccgggaaccctggtctccgtctcctcagcctccaccagggcccatcggtcttccccctggccaccctcctccagacgcacctctgggggcacacgcggcccgtgggctcgcctggtcaaggacctacttccactgtacagtctgagcgggctggcaggcgcatagnnnnnnnnnn

SEQ ID NO: 175819 - DNA, 457 bp, Homo sapiens
  misc_feature: GYAE6OF02GX37C.25.12.B01.1.454.CMB.1.raw
  modified_base (445)..(457): a, c, t, g, unknown or other
  misc_feature (445)..(457): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccggggacaacgccaggaagtccctctatctgcgactgagcaacctgagagtcgaagacacggccatttactactgtacgacagacccccgacgatgtgactcctggggcccgggaaccctggtctccgtctcctcagcctccaccaagggccccactcggtccttcccccctggcaccctccctccaagagcacctctggggcacagcggccctgggctgcctggtcaaggactacttccactgtacagtctgagcgggctggcaaggcgcatagnnnnnnnnnnnnn

SEQ ID NO: 175820 - DNA, 669 bp, Homo sapiens
  misc_feature: GYAE6OF02H1YB1.25.12.B01.1.454.CMB.1.raw
  modified_base (618)..(618): a, c, t, g, unknown or other
  misc_feature (618)..(618): n is a, c, g, or t
  modified_base (633)..(633): a, c, t, g, unknown or other
  misc_feature (633)..(633): n is a, c, g, or t
tcagactgtacagtcacgaccggtgctcgatttagtagtgtagatttcggggtcggtgccctttggactttgggagagtggttttcgtcgatgggggactggaggtggctttcataccagttagtggaagttggtcattgacattaactacgcagactctcgtggaagggccgattcaccagtctcccagggtaccaacgcccacggaaggtccctctatctgcgactgagccaacctgacgagtcgaagacacggccactttaactactgttacgacaccgaccccgagaatacgtcgtactccttggggccccggaacctggtcgtaccgtctcctacacgccctaccaccgaagggccctagtccggtccttccccccgtcggccaccccttcccgtaccaacgacgtccaccgttcgtcgggggcacggacgccgggtccccgtagggtcctcgcccgttacggtaccgtaaaggtaccttaaccgttcccaacgttacgtaccgacgttcgtacggacggtccgggacgttggggaccgaaacggtccggttaacctaacgttacggctcgacagtatactacttcgtctacgtctacggcgtacgagtaggnacgactacgaacgtntacggacgtcgtacgactcgactacgtactctctac

SEQ ID NO: 175821 - DNA, 683 bp, Homo sapiens
  misc_feature: GYAE6OF02FGDMA.25.12.B01.1.454.CMB.1.raw
  modified_base (610)..(610): a, c, t, g, unknown or other
  misc_feature (610)..(610): n is a, c, g, or t
  modified_base (676)..(676): a, c, t, g, unknown or other
  misc_feature (676)..(676): n is a, c, g, or t
tcagactgtacagtcacgaccggtgctcgatttagtagtgtagattcggggtcgtgccctttggctttggagatggttttcgtcgatggggctggagtggcttcatacattagtggaagtgtcatgacattaactacgcagactctgtgaaggccgattcaccatctccagggaccaacgccaggaacgtccctctatctgcgactgacgccaacctgacgacgtcgaagaccaccggccattactactgtaccgaccaccgacccccgagactgtacgactccgtcggggaccccggtaaccctggtacctaccgtcctccctcaccgtccctaccgaccgtaacggtccctagttccggtccctttcccccggtggcccctaaccccgttcccgtacccaaacggtcgtccgtaccgttcggtacgggggacccacggtaccggtcccggtccccgttacggggtcctacggtcccgttacgggtaaccaacggtaccttacccgttcccacgttacgtacctacggttctacgggacggtccgggtaccgtacgggaccgtaacgggtccgtaacctagttacgactactactactacgtctacgtntaccgtagtacgcgacgtacggtagtcgtacacacgtacgtacgcgtacgacgcgacactctctcnctctctc

SEQ ID NO: 175822 - DNA, 515 bp, Homo sapiens
  misc_feature: GYAE6OF02JEX1Y.25.12.B01.1.454.CMB.1.raw
  modified_base (453)..(453): a, c, t, g, unknown or other
  misc_feature (453)..(453): n is a, c, g, or t
  modified_base (491)..(492): a, c, t, g, unknown or other
  misc_feature (491)..(492): n is a, c, g, or t
  modified_base (494)..(515): a, c, t, g, unknown or other
  misc_feature (494)..(515): n is a, c, g, or t
tcagactgtacagtcacgaccggtgctcgatttagtagtgtagattcggggctgccctttggctttggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtaccgacacgacccccgagatgtgactccgtggggccccgggaacctggtcctccgtctcctcacgccctccaccgaacgggcccacgtccggtccttcccccgtcggcccacccctcctccaacgacgccacctcgtcgggggcacgacgccggcccgtcgggccgtgcccgtggtaccgaacggtaccttaccttccactcgtaacncgtctagacggcgggcgtgggacaacgggcgcagtagnngnnnnnnnnnnnnnnnnnnnnnn

SEQ ID NO: 175823 - DNA, 191 bp, Homo sapiens
  misc_feature: GYAE6OF01CTRKC.51.82.H05.1.454.CMB.1.raw
  modified_base (191)..(191): a, c, t, g, unknown or other
  misc_feature (191)..(191): n is a, c, g, or t
tcagcgatcgtatacacgaccggtgctcgatttagtcgagctctctcgcgggcacgaccggtgctcgatttagtcgagctctctcgcggcacgaccggtgctcgatttagtgtcacacgaaggaaaggcagcgtcactctgttcccgccctcctctcgtagcactctgagcgggctggcaaggcgcatagn

SEQ ID NO: 175824 - DNA, 178 bp, Homo sapiens
  misc_feature: GYAE6OF01A157T.51.82.H05.1.454.CMB.1.raw
  modified_base (178)..(178): a, c, t, g, unknown or other
  misc_feature (178)..(178): n is a, c, g, or t
tcagcgatcgtatacacgaccggtgctcgatttagtcgagctctctcgcgggctcgatttagtcgagctctctcgcggcacgaccggtgctcgatttagagtgctacgaaggaaggcagcgtcactctgttcccgcctcctctcgtagcactctgagcgggctggcaaggcgcatagn

SEQ ID NO: 175825 - DNA, 197 bp, Homo sapiens
  misc_feature: GYAE6OF01D2OCM.51.82.H05.1.454.CMB.1.raw
  modified_base (193)..(197): a, c, t, g, unknown or other
  misc_feature (193)..(197): n is a, c, g, or t
tcagcgatcgtatacacgaccggtgctcgatttagtcgagctctctcgcgggcacgaccggtgctcgatttagtcgagctctctcgcgggcacgaccggtgctcgatttagtctgatcgagaaggaaaggcagcgtcactctgttcccgccctcctctcgtagcactctgagcgggctggcaaggcgcatagnnnnn

SEQ ID NO: 175826 - DNA, 161 bp, Homo sapiens
  misc_feature: GYAE6OF01B6OJ0.51.82.H05.1.454.CMB.1.raw
  modified_base (153)..(161): a, c, t, g, unknown or other
  misc_feature (153)..(161): n is a, c, g, or t
tcagcgatcgtatacacgaccggtgctcgatttagtcgagctctctcgcgggcacgaccggtgctcgatttagagtgctacgaagggaaggcagcgtcactctgttcccgcctcctctcgtagcactctgagcgggctggcaaggcgcatagnnnnnnnnn

SEQ ID NO: 175827 - DNA, 155 bp, Homo sapiens
  misc_feature: GYAE6OF01AS62H.51.82.H05.1.454.CMB.1.raw
  modified_base (153)..(155): a, c, t, g, unknown or other
  misc_feature (153)..(155): n is a, c, g, or t
tcagcgatcgtatacacgaccggtgctcgatttagtcgagctctctcgcgggcacgaccggtgctcgatttagagtgctacgaaggaaggcagcgtcactctgttcccaccctcctctcgtagcactctgagcgggctggcaaggcgcatagnnn

SEQ ID NO: 175828 - DNA, 231 bp, Homo sapiens
  misc_feature: GYAE6OF01B9HSS.51.82.H05.1.454.CMB.1.raw
  modified_base (229)..(231): a, c, t, g, unknown or other
  misc_feature (229)..(231): n is a, c, g, or t
tcagcgatcgtatacacgaccggtgctcgatttagtcgagctctctcgcgggcacgaccggtgctcgatttagctctacgctcagggcacgaccggtgctcgatttagtcgagctctctcgcgggcacgaccggtgctcgatttagtctgatcgagaagggaaaggcagcgtcactctgttcccaccctcctctcgtagcactctgagcgggctggcaaggcgcatagnnn

SEQ ID NO: 175829 - DNA, 155 bp, Homo sapiens
  misc_feature: GYAE6OF01CCIEI.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaagggcagcgtcactctgttcccgccctcctctcgtagcactctgagcgggctggcaaggcgcatagn

SEQ ID NO: 175830 - DNA, 191 bp, Homo sapiens
  misc_feature: GYAE6OF01CV1Z6.51.82.H05.1.454.CMB.1.raw
  modified_base (190)..(191): a, c, t, g, unknown or other
  misc_feature (190)..(191): n is a, c, g, or t
tcagcgatcgtatacacgaccggtgctcgatttagtcgagctctctcgcgggcacgaccggtgctcgatttagtcgagctctctcgcggcacgaccggtgctcgatttagagtgctacgaaggaaggcagcgtcactctgttcccaccctcctctcgtagcactctgagcgggctggcaaggcgcatagnn

SEQ ID NO: 175831 - DNA, 153 bp, Homo sapiens
  misc_feature: GYAE6OF01DH0ED.51.82.H05.1.454.CMB.1.raw
  modified_base (152)..(153): a, c, t, g, unknown or other
  misc_feature (152)..(153): n is a, c, g, or t
tcagcgatcgtatacacgaccggtgctcgatttagtcgagctctctcgcgggcacgaccggtgctcgatttagagtgctacgaagggaaggcagcgtcactctgttcccacctctctcgtagcactctgagcgggctggcaaggcgcatagnn

SEQ ID NO: 175832 - DNA, 243 bp, Homo sapiens
  misc_feature: GYAE6OF01CCUJQ.51.82.H05.1.454.CMB.1.raw
  modified_base (230)..(243): a, c, t, g, unknown or other
  misc_feature (230)..(243): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagtgctacgaagggaaggcagcgtcactctgttcccgccctcctctcgtagcactctgagcgggctggcaaggcgcatagnnnnnnnnnnnnnn

SEQ ID NO: 175833 - DNA, 194 bp, Homo sapiens
  misc_feature: GYAE6OF01B7Z7R.51.82.H05.1.454.CMB.1.raw
  modified_base (191)..(194): a, c, t, g, unknown or other
  misc_feature (191)..(194): n is a, c, g, or t
tcagcgatcgtatacacgaccggtgctcgatttagtcgagctctctcgcgggcacgaccggtgctcgatttagtcgagctctctcgcggcacgaccggtgctcgatttagagtgctacgaagggaaggcagcgtcactctgttcccgccctcctctcgtagcactctgagcgggctggcaaggcgcatagnnnn

SEQ ID NO: 175834 - DNA, 155 bp, Homo sapiens
  misc_feature: GYAE6OF01DEATB.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaaagggcagcgtcactctgttcccgcctcctctcgtagcactctgagcgggctggcaaggcgcatagn

SEQ ID NO: 175835 - DNA, 157 bp, Homo sapiens
  misc_feature: GYAE6OF01EVV5Y.51.82.H05.1.454.CMB.1.raw
  modified_base (156)..(157): a, c, t, g, unknown or other
  misc_feature (156)..(157): n is a, c, g, or t
tcagcgatcgtatacacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagnn

SEQ ID NO: 175836 - DNA, 185 bp, Homo sapiens
  misc_feature: GYAE6OF01E2T63.51.82.H05.1.454.CMB.1.raw
  modified_base (185)..(185): a, c, t, g, unknown or other
  misc_feature (185)..(185): n is a, c, g, or t
tcagcgatcgtatacacgaccggtgctcgatttagtcgagctctctcgcgggtgctcgatttagtcgagctctctcgcgggcacgaccggtgctcgatttagagtgctacgaagggaaagggcagcgtcactctgttcccaccctcctctcgtagcactctgagcgggctggcaaggcgcatagn

SEQ ID NO: 175837 - DNA, 158 bp, Homo sapiens
  misc_feature: GYAE6OF01EH4BC.51.82.H05.1.454.CMB.1.raw
  modified_base (157)..(158): a, c, t, g, unknown or other
  misc_feature (157)..(158): n is a, c, g, or t
tcagcgatcgtatacacgaccggtgctcgatttagtcgagctctctcgcgggcacgaccggtgctcgatttagtagtcgcataaagggaaagggcagcgtcactctgttcccgccctcctctcgtagcactctgagcgggctggcaaggcgcatagnn

SEQ ID NO: 175838 - DNA, 195 bp, Homo sapiens
  misc_feature: GYAE6OF01D8WSX.51.82.H05.1.454.CMB.1.raw
  modified_base (193)..(195): a, c, t, g, unknown or other
  misc_feature (193)..(195): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaagggcagcgtcactctgttcccgccctcctctcgtagcactctgagcgggctggcaaggcgcatagnnn

SEQ ID NO: 175839 - DNA, 153 bp, Homo sapiens
  misc_feature: GYAE6OF01EIT8W.51.82.H05.1.454.CMB.1.raw
  modified_base (153)..(153): a, c, t, g, unknown or other
  misc_feature (153)..(153): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctctcgtagcactctgagcgggctggcaaggcgcatagn

SEQ ID NO: 175840 - DNA, 155 bp, Homo sapiens
  misc_feature: GYAE6OF01ARNTW.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaagggcagcgtcactctgttcccaccctcctctcgtagcactctgagcgggctggcaaggcgcatagn

SEQ ID NO: 175841 - DNA, 154 bp, Homo sapiens
  misc_feature: GYAE6OF01AU4F4.51.82.H05.1.454.CMB.1.raw
  modified_base (154)..(154): a, c, t, g, unknown or other
  misc_feature (154)..(154): n is a, c, g, or t
tcagcgatcgtatacacgaccggtgctcgatttagtcgagctctctcgcgggcacgaccggtgctcgatttagagtgctacgaagggaaaggcagcgtcactctgttcccgcctcctctcgtagcactctgagcgggctggcaaggcgcatagn

SEQ ID NO: 175842 - DNA, 155 bp, Homo sapiens
  misc_feature: GYAE6OF01BB0LB.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaaagggcagcgtcactctgttcccacctcctctcgtagcactctgagcgggctggcaaggcgcatagn

SEQ ID NO: 175843 - DNA, 156 bp, Homo sapiens
  misc_feature: GYAE6OF01A3XDS.51.82.H05.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagn

SEQ ID NO: 175844 - DNA, 191 bp, Homo sapiens
  misc_feature: GYAE6OF01D8M70.51.82.H05.1.454.CMB.1.raw
  modified_base (191)..(191): a, c, t, g, unknown or other
  misc_feature (191)..(191): n is a, c, g, or t
tcagcgatcgtatacacgaccggtgctcgatttagtcgagctctctcgcgggcacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagn

SEQ ID NO: 175845 - DNA, 191 bp, Homo sapiens; identical to SEQ ID NO: 175844
  misc_feature: GYAE6OF01AMG8X.51.82.H05.1.454.CMB.1.raw
  modified_base (191)..(191): a, c, t, g, unknown or other
  misc_feature (191)..(191): n is a, c, g, or t

SEQ ID NO: 175846 - DNA, 193 bp, Homo sapiens
  misc_feature: GYAE6OF01B3OAC.51.82.H05.1.454.CMB.1.raw
  modified_base (193)..(193): a, c, t, g, unknown or other
  misc_feature (193)..(193): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaaggcagcgtcactctgttcccaccctcctctcgtagcactctgagcgggctggcaaggcgcatagn

SEQ ID NO: 175847 - DNA, 225 bp, Homo sapiens
  misc_feature: GYAE6OF01B60JI.51.82.H05.1.454.CMB.1.raw
  modified_base (205)..(225): a, c, t, g, unknown or other
  misc_feature (205)..(225): n is a, c, g, or t
tcagcgatcgtatacacgaccggtgctcgatttagtcgagctctctcgcgggcacgaccggtgctcgatttagtcgagctctctcgcgggcacgaccgtgctcgatttagtcgagctcgtctacggcggctggcaaggcgcatagctggcctggtcaaggactacttcctcgtagcactctgagcgggctggcaaggcgcatagnnnnnnnnnnnnnnnnnnnnn

SEQ ID NO: 175848 - DNA, 204 bp, Homo sapiens
  misc_feature: GYAE6OF01DXCCL.51.82.H05.1.454.CMB.1.raw
  modified_base (193)..(204): a, c, t, g, unknown or other
  misc_feature (193)..(204): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaggcaggcgtcactctgttcccaccctcctctcgtagcactctgagcgggctggcaaggcgcatagnnnnnnnnnnnn

SEQ ID NO: 175849 - DNA, 129 bp, Homo sapiens
  misc_feature: GYAE6OF01B0F7U.51.82.H05.1.454.CMB.1.raw
  modified_base (127)..(129): a, c, t, g, unknown or other
  misc_feature (127)..(129): n is a, c, g, or t
tcagcgatcgtatacacgaccggtgctcgatttagtcgagctctctcgcgggctggcaaggcgcatagctgcctggtcaaggactacttcctcgtagcactctgagcgggctggcaaggcgcatagnnn

SEQ ID NO: 175850 - DNA, 193 bp, Homo sapiens
  misc_feature: GYAE6OF01BUTV4.51.82.H05.1.454.CMB.1.raw
  modified_base (180)..(180): a, c, t, g, unknown or other
  misc_feature (180)..(180): n is a, c, g, or t
  modified_base (185)..(193): a, c, t, g, unknown or other
  misc_feature (185)..(193): n is a, c, g, or t
tcagcgatcgtatacacgaccggtgctcgatttagtcgagctctctcgcgggcacgaccggtgctcgatttagtcgagctctctcgcggcacgaccggtgctcgatttagagtgctagaggaaggcagcgtcactctgttcccgcctcctctcgtagcactctgagcggctggcaaggcncatgnnnnnnnnn

SEQ ID NO: 175851 - DNA, 158 bp, Homo sapiens
  misc_feature: GYAE6OF01AX71E.51.82.H05.1.454.CMB.1.raw
  modified_base (156)..(158): a, c, t, g, unknown or other
  misc_feature (156)..(158): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagnnn

SEQ ID NO: 175852 - DNA, 234 bp, Homo sapiens
  misc_feature: GYAE6OF01CVKOT.51.82.H05.1.454.CMB.1.raw
  modified_base (233)..(234): a, c, t, g, unknown or other
  misc_feature (233)..(234): n is a, c, g, or t
tcagcgatcgtatacacgaccggtgctcgatttagtcgagctctctcgcgggcacgaccggtgctcgatttagacagtatatatccgcgggcacgaccgtgctcgatttagacagtatatatccgcgggcacgaccggtgctcgatttagagtgctacgaagggaaagggcagcgtcactctgttcccgccctcctctcgtagcactctgagcgggctggcaaggcgcatagnn

SEQ ID NO: 175853 - DNA, 155 bp, Homo sapiens
  misc_feature: GYAE6OF01D4LNZ.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctcctctcgagcactctgagcgggctggcaaggcgcatagn

SEQ ID NO: 175854 - DNA, 156 bp, Homo sapiens
  misc_feature: GYAE6OF01ES57W.51.82.H05.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctctcgcgggcacgaccggtgctcgatttagtcgatagtgaagggaaagggcagcgtcactctgttcccaccctcctctcgtagcactctgagcgggctggcaaggcgcatagn

SEQ ID NO: 175855 - DNA, 160 bp, Homo sapiens
  misc_feature: GYAE6OF01CRTKD.51.82.H05.1.454.CMB.1.raw
  modified_base (155)..(160): a, c, t, g, unknown or other
  misc_feature (155)..(160): n is a, c, g, or t
tcagcgatcgtatacacgaccggtgctcgatttagtcgagctctctcgcgggcacgaccggtgctcgatttagagtgctacgaagggaaaggcagcgtcactctgttcccaccctcctctcgtagcactctgagcgggctggcaaggcgcatagnnnnnn

SEQ ID NO: 175856 - DNA, 154 bp, Homo sapiens
  misc_feature: GYAE6OF01CNPW3.51.82.H05.1.454.CMB.1.raw
  modified_base (153)..(154): a, c, t, g, unknown or other
  misc_feature (153)..(154): n is a, c, g, or t
tcagcgatcgtatacacgaccggtgctcgatttagtcgagctctctcgcgggcacgaccggtgctcgatttagagtgctacgaagggaaggcagcgtcactctgttcccacctcctctcgtagcactctgagcgggctggcaaggcgcatagnn

SEQ ID NO: 175857 - DNA, 157 bp, Homo sapiens; identical to SEQ ID NO: 175835
  misc_feature: GYAE6OF01DCO9N.51.82.H05.1.454.CMB.1.raw
  modified_base (156)..(157): a, c, t, g, unknown or other
  misc_feature (156)..(157): n is a, c, g, or t

SEQ ID NO: 175858 - DNA, 156 bp, Homo sapiens
  misc_feature: GYAE6OF01BCYRV.51.82.H05.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctctcgcgggcacgaccggtgctcgatttagtgtcacacgaagggaaagggcagcgtcactctgttcccgccctcctctcgtagcactctgagcgggctggcaaggcgcatagn

SEQ ID NO: 175859 - DNA, 156 bp, Homo sapiens
  misc_feature: GYAE6OF01CLQ5D.51.82.H05.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagn

SEQ ID NO: 175860 - DNA, 126 bp, Homo sapiens
  misc_feature: GYAE6OF01DV94R.51.82.H05.1.454.CMB.1.raw
  modified_base (124)..(126): a, c, t, g, unknown or other
  misc_feature (124)..(126): n is a, c, g, or t
tcagcgatcgtatacacgaccggtgctcgatttagtcgagctctctcgcgggcacgaccggtgctcgatttggtcaaggactacttcctcgtagcactctgagcgggctggcaaggcgcatagnnn

SEQ ID NO: 175861 - DNA, 154 bp, Homo sapiens
  misc_feature: GYAE6OF01C9UVZ.51.82.H05.1.454.CMB.1.raw
  modified_base (154)..(154): a, c, t, g, unknown or other
  misc_feature (154)..(154): n is a, c, g, or t
tcagcgatcgtatacacgaccggtgctcgatttagtcgagctctctcgcgggcacgaccggtgctcgatttagagtgctacgaagggaaaggcagcgtcactctgttcccacctcctctcgtagcactctgagcgggctggcaaggcgcatagn

SEQ ID NO: 175862 - DNA, 235 bp, Homo sapiens
  misc_feature: GYAE6OF01A54BH.51.82.H05.1.454.CMB.1.raw
  modified_base (233)..(235): a, c, t, g, unknown or other
  misc_feature (233)..(235): n is a, c, g, or t
tcagcgatcgtatacacgaccggtgctcgatttagtcgagctctctcgcgggcacgaccggtgctcgatttagtcgagctctctcgcgggcacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagnnn

SEQ ID NO: 175863 - DNA, 156 bp, Homo sapiens; identical to SEQ ID NO: 175843
  misc_feature: GYAE6OF01E2UY9.51.82.H05.1.454.CMB.1.raw
  modified_base (156)..(156): a, c, t, g, unknown or other
  misc_feature (156)..(156): n is a, c, g, or t

SEQ ID NO: 175864 - DNA, 200 bp, Homo sapiens
  misc_feature: GYAE6OF01DENUT.51.82.H05.1.454.CMB.1.raw
  modified_base (195)..(200): a, c, t, g, unknown or other
  misc_feature (195)..(200): n is a, c, g, or t
tcagcgatcgtatacacgaccggtgctcgatttagtcgagctctctcgcgggcacgaccggtgctcgatttagtagtgtagattccgcgggcacgaccggtgctcgatttagctacgctctaagggaaagggcagcgtcactctgttcccgccctcctctcgtagcactctgagcgggctggcaaggcgcatagnnnnnn

SEQ ID NO: 175865 - DNA, 157 bp, Homo sapiens
  misc_feature: GYAE6OF01BLNU3.51.82.H05.1.454.CMB.1.raw
  modified_base (156)..(157): a, c, t, g, unknown or other
  misc_feature (156)..(157): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagnn

SEQ ID NO: 175866 - DNA, 191 bp, Homo sapiens
  misc_feature: GYAE6OF01C2G4U.51.82.H05.1.454.CMB.1.raw
  modified_base (191)..(191): a, c, t, g, unknown or other
  misc_feature (191)..(191): n is a, c, g, or t
tcagcgatcgtatacacgaccggtgctcgatttagtcgagctctctcgcgggcacgaccggtgctcgatttagtcgagctctctcgcggcacgaccggtgctcgatttagagtgctacgaagggaaggcagcgtcactctgttcccgccctcctctcgtagcactctgagcgggctggcaaggcgcatagn

SEQ ID NO: 175867 - DNA, 195 bp, Homo sapiens
  misc_feature: GYAE6OF01A5STX.51.82.H05.1.454.CMB.1.raw
  modified_base (194)..(195): a, c, t, g, unknown or other
  misc_feature (194)..(195): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagnn

SEQ ID NO: 175868 - DNA, 157 bp, Homo sapiens
  misc_feature: GYAE6OF01ELYNP.51.82.H05.1.454.CMB.1.raw
  modified_base (156)..(157): a, c, t, g, unknown or other
  misc_feature (156)..(157): n is a, c, g, or t
tcagcgatcgtatacacgaccggtgctcgatttagtcgagctctctcgcgggcacgaccggtgctcgatttagtcgatagtgaagggaaagggcagcgtcactctgttcccaccctcctctcgtagcactctgagcgggctggcaaggcgcatagnn

SEQ ID NO: 175869 - DNA, 182 bp, Homo sapiens
  misc_feature: GYAE6OF01DMP3D.51.82.H05.1.454.CMB.1.raw
  modified_base (159)..(159): a, c, t, g, unknown or other
  misc_feature (159)..(159): n is a, c, g, or t
  modified_base (181)..(182): a, c, t, g, unknown or other
  misc_feature (181)..(182): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagcgagctctcngcgggctggcaaggcgcatagnn

SEQ ID NO: 175870 - DNA, 191 bp, Homo sapiens
  misc_feature: GYAE6OF01BCN8W.51.82.H05.1.454.CMB.1.raw
  modified_base (191)..(191): a, c, t, g, unknown or other
  misc_feature (191)..(191): n is a, c, g, or t
tcagcgatcgtatacacgaccggtgctcgatttagtcgagctctctcgcgggcacgaccggtgctcgatttagtcgagctctctcgcgggcagaccggtgctcgatttagagtgctacgaagggaaggcagcgtcactctgttcccgccctcctctcgtagcactctgagcgggctggcaaggcgcatagn

SEQ ID NO: 175871 - DNA, 156 bp, Homo sapiens
  misc_feature: GYAE6OF01C533Y.51.82.H05.1.454.CMB.1.raw
  modified_base (156)..(156): a, c, t, g, unknown or other
  misc_feature (156)..(156): n is a, c, g, or t
tcagcgatcgtatacacgaccggtgctcgatttagtcgagctctctcgcgggcacgaccggtgctcgatttagagtgctacgaagggaaagggcagcgtcactctgttcccgccctccactcgtagcactctgagcgggctggcaaggcgcatagn

SEQ ID NO: 175872 - DNA, 155 bp, Homo sapiens
  misc_feature: GYAE6OF01BDUE2.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaaaggcagcgtcactctgttcccgccctcctctcgtagcactctgagcgggctggcaaggcgcatagn

SEQ ID NO: 175873 - DNA, 201 bp, Homo sapiens
  misc_feature: GYAE6OF01BKQIL.51.82.H05.1.454.CMB.1.raw
  modified_base (194)..(201): a, c, t, g, unknown or other
  misc_feature (194)..(201): n is a, c, g, or t
tcagcgatcgtatacacgaccggtgctcgatttagtcgagctctctcgcgggcacgaccggtgctcgatttagagtgctacgaagggaaaggcacgaccggtgctcgatttagagtgctacgaagggaaggcagcgtcactctgttcccaccctcctctcgtagcactctgagcgggctggcaaggcgcatagnnnnnnnn

SEQ ID NO: 175874 - DNA, 195 bp, Homo sapiens; identical to SEQ ID NO: 175867
  misc_feature: GYAE6OF01ADBHH.51.82.H05.1.454.CMB.1.raw
  modified_base (194)..(195): a, c, t, g, unknown or other
  misc_feature (194)..(195): n is a, c, g, or t

SEQ ID NO: 175875 - DNA, 157 bp, Homo sapiens; identical to SEQ ID NO: 175865
  misc_feature: GYAE6OF01DYDHF.51.82.H05.1.454.CMB.1.raw
  modified_base (156)..(157): a, c, t, g, unknown or other
  misc_feature (156)..(157): n is a, c, g, or t

SEQ ID NO: 175876 - DNA, 976 bp, Homo sapiens
  misc_feature: GYAE6OF01END7B.51.82.H05.1.454.CMB.1.raw
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
tcagcgatcgtatacacgaccggtgctcgatttagtcgagctctctcgcgggtctgcttcagctgtggcacaagaggcagcactcaggacaatctccagccatggcctggtctcctctcctcctcactctcctcgctcactgcacagggtcctggcccagtctgtactgacgcagccgcctnagtgtctgggcccaggcagnggtcaccatctctgcacgtggaactgttccaactagtcggggactaggttactaacgtcgtaacctacgtacggtaccaggtacctaaaccgtttccgaaggtaacctaccggtacccccctaaacgttcccgtacacgttcccgtaagtcgtaacgtacccgtaaggtaaaccgttccggtaccccggttaccgggggtaccctacggtaacccgtaacgtttcccgtaccgtacggtccgttaacccgtaacggttccgtaccggtaaccgttaacccgtttaccgtaaacccggttcccccgtttacccccggttaaggggtacccccttaaacgggtttacccccgtaaaccgggtttacccgggggtaacccttttaacccccgggtaaacggggtttaacccgtttaccggggtaaaccgggttaaccggtttaccggggtaaacgggtttaccccggtttaacgggttaaacccgttttacggttttaaaccccggttaccgggtaaccccggtttaaccggttttaccccgttaaacgggtttaccggtaaaccccgggtttaaccgggtacccggttaaaccggggtttacccgttaaccggggttaaaccccggttttccgggtacccgggtttttaaccggggttttacccgggggtttttaccccggggacccggggttaacccgggggttaacccctttaaacggggtaccccggttttacccgggttaaacccccggttccgggttttaaaacccggggg

SEQ ID NO: 175877 - DNA, 156 bp, Homo sapiens; identical to SEQ ID NO: 175859
  misc_feature: GYAE6OF01AZZIU.51.82.H05.1.454.CMB.1.raw
  modified_base (156)..(156): a, c, t, g, unknown or other
  misc_feature (156)..(156): n is a, c, g, or t

SEQ ID NO: 175878 - DNA, 164 bp, Homo sapiens
  misc_feature: GYAE6OF01AOGH3.51.82.H05.1.454.CMB.1.raw
  modified_base (154)..(164): a, c, t, g, unknown or other
  misc_feature (154)..(164): n is a, c, g, or t
tcagcgatcgtatacacgaccggtgctcgatttagtcgagctctctcgcgggcacgaccggtgctcgatttagagtgctacgaagggaaggcagcgtcactctgttcccaccctcctctcgtagcactctgagcgggctggcaaggcgcatagnnnnnnnnnnn

SEQ ID NO: 175879 - DNA, 199 bp, Homo sapiens
  misc_feature: GYAE6OF01AB8F9.51.82.H05.1.454.CMB.1.raw
  modified_base (194)..(199): a, c, t, g, unknown or other
  misc_feature (194)..(199): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagnnnnnn

SEQ ID NO: 175880 - DNA, 156 bp, Homo sapiens; identical to SEQ ID NO: 175859
  misc_feature: GYAE6OF01ECUXN.51.82.H05.1.454.CMB.1.raw
  modified_base (156)..(156): a, c, t, g, unknown or other
  misc_feature (156)..(156): n is a, c, g, or t

SEQ ID NO: 175881 - DNA, 156 bp, Homo sapiens; identical to SEQ ID NO: 175854
  misc_feature: GYAE6OF01CEQQZ.51.82.H05.1.454.CMB.1.raw
  modified_base (156)..(156): a, c, t, g, unknown or other
  misc_feature (156)..(156): n is a, c, g, or t

SEQ ID NO: 175882 - DNA, 155 bp, Homo sapiens
  misc_feature: GYAE6OF01B4HNX.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaaaggcagcgtcactctgttcccatcctcctctcgtagcactctgagcgggctggcaaggcgcatagn

SEQ ID NO: 175883 - DNA, 155 bp, Homo sapiens
  misc_feature: GYAE6OF01EVEN2.51.82.H05.1.454.CMB.1.raw
  modified_base (154)..(155): a, c, t, g, unknown or other
  misc_feature (154)..(155): n is a, c, g, or t
tcagcgatcgtatacacgaccggtgctcgatttagtcgagctctctcgcggcacgaccggtgctcgatttagagtgctacgaagggaagggcagcgtcactctgttcccgccctcctctcgtagcactctgagcgggctggcaaggcgcatagnn

SEQ ID NO: 175884 - DNA, 157 bp, Homo sapiens
  misc_feature: GYAE6OF01A574J.51.82.H05.1.454.CMB.1.raw
  modified_base (157)..(157): a, c, t, g, unknown or other
  misc_feature (157)..(157): n is a, c, g, or t
tcagcgatcgtatacacgaccggtgctcgatttagtcgagctctctcgcgggcacgaccggtgctcgatttagctgtgcgtcgaagggaaagggcagcgtcactctgttcccaccctcctctcgtagcactctgagcgggctggcaaggcgcatagn

SEQ ID NO: 175885 - DNA, 289 bp, Homo sapiens
  misc_feature: GYAE6OF01DPA6G.51.82.H05.1.454.CMB.1.raw
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (280)..(289): a, c, t, g, unknown or other
  misc_feature (280)..(289): n is a, c, g, or t
tcagcgatcgtatacacgaccggtgctcgatttagtcgagctctctcgcgggcacgaccggtgctcgattttagtcgagctctctcggcgggcacgaccggtgctcgtatttagtcgagcgtcgtacgtcggcgggcacgaccggtgctccgtactttacgctcgtacgctacgagggcacgccggtgctcgaatttacgagtgctacggaagggaaggcagcgtcactcgtcgttcccacctctctcgtagcactnagngcggctggcaaggcncatgnnnnnnnnnn

SEQ ID NO: 175886 - DNA, 182 bp, Homo sapiens
  misc_feature: GYAE6OF01A2X0M.51.82.H05.1.454.CMB.1.raw
  modified_base (165)..(182): a, c, t, g, unknown or other
  misc_feature (165)..(182): n is a, c, g, or t
tcagcgatcgtatacacgaccggtgctcgatttagtcgagctctctcgcgggcacgaccggtgctcgatttagtcgagctctctcgcgggctggcaaggcgcatagctgcctggtcaaggactacttcctcgtagcactctgagcgggctggcaaggcgcatagnnnnnnnnnnnnnnnnnn

SEQ ID NO: 175887 - DNA, 195 bp, Homo sapiens
  misc_feature: GYAE6OF01C1CT4.51.82.H05.1.454.CMB.1.raw
  modified_base (194)..(195): a, c, t, g, unknown or other
  misc_feature (194)..(195): n is a, c, g, or t
tcagcgatcgtatacacgaccggtgctcgatttagtcgagctctctcgcgggcacgaccggtgctcgatttagtcgagctctcgtcgcgggcacgaccggtgctcgatttagagtgctacgaagggaaaggcagcgtcactctgttcccaccctcctctcgtagcactctgagcgggctggcaaggcgcatagnn

SEQ ID NO: 175888 - DNA, 154 bp, Homo sapiens
  misc_feature: GYAE6OF01BWMU7.51.82.H05.1.454.CMB.1.raw
tcagcgatcgtatacacgaccggtgctcgattagtcgagctctctcgcggtcacgaccggtgctcgatttagagtgctacgaagggaaagggcagcgtcactctgttcccgccctcctctcgtagcactctgagcgggctggcaaggcgcatag

SEQ ID NO: 175889 - DNA, 551 bp, Homo sapiens
  misc_feature: GYAE6OF01D6KF6.51.82.H05.1.454.CMB.1.raw
  modified_base (454)..(454): a, c, t, g, unknown or other
  misc_feature (454)..(454): n is a, c, g, or t
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggcccccagggcagagggtcaccatctcctgcacgtgggaacagttccaacagtcggggcaggttataatgtacactggtaccagcaacttccaggaaccacgacccccaaactcctcactccatagactaccagaactccggcccgtcggggtccctgaccgtattctctggcctccgaagtctagactacttcacgtccctcccgtggcccatccacgtcgggcctccgagactggaggatgaggtctgactattacncgcctagtcctagtcgacacgcaggctagacgtgtcgttgggttcggtttccgggcggtaccgggtacctaacgccgtacggcccgttcgtaacggg

SEQ ID NO: 175890 - DNA, 195 bp, Homo sapiens
  misc_feature: GYAE6OF01AYG9Y.51.82.H05.1.454.CMB.1.raw
  modified_base (193)..(195): a, c, t, g, unknown or other
  misc_feature (193)..(195): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaaggcagcgtcactctgttcccgccctcctctcgtagcactctgagcgggctggcaaggcgcatagnnn

SEQ ID NO: 175891 - DNA, 505 bp, Homo sapiens
  misc_feature: GYAE6OF01ECX3K.51.82.H05.1.454.CMB.1.raw
  modified_base (235)..(235): a, c, t, g, unknown or other
  misc_feature (235)..(235): n is a, c, g, or t
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacngttccaacatcggggcaggttataatgtacactggtaccagcaacttccaggaacacgcccccaaactcctcactccatgataccagaaactcggccctcgggggtccctgaccgattctctggctccaagtctgaccacttcagccctccctggccatcactgggctccgagactgaggatggagctgactattactgcctagtcctagtgacagcaggctgactgcttggttcggtttcggcggcggacaagctacgccgtcgtacgg

SEQ ID NO: 175892 - DNA, 117 bp, Homo sapiens
  misc_feature: GYAE6OF01CCUEQ.51.82.H05.1.454.CMB.1.raw
  modified_base (117)..(117): a, c, t, g, unknown or other
  misc_feature (117)..(117): n is a, c, g, or t
tcagcgatcgtatacacgaccggtgctcgatttagtcgagctctctcgcgggctctcgcgggcacgaccggtgctcgatttagtcgagctctctcgcgggctggcaaggcgcatagn

SEQ ID NO: 175893 - DNA, 156 bp, Homo sapiens; identical to SEQ ID NO: 175843
  misc_feature: GYAE6OF01CDHW0.51.82.H05.1.454.CMB.1.raw
  modified_base (156)..(156): a, c, t, g, unknown or other
  misc_feature (156)..(156): n is a, c, g, or t

SEQ ID NO: 175894 - DNA, 105 bp, Homo sapiens
  misc_feature: GYAE6OF01BJ9VF.51.82.H05.1.454.CMB.1.raw
tcagcgatcgtatacacgaccggtgctcgatttagtcgagctctctcgcgggcacgaccggtgctcgatttagtcgagctctctgcgggctggcaaggcgcatag

SEQ ID NO: 175895 - DNA, 196 bp, Homo sapiens
  misc_feature: GYAE6OF01EZK5M.51.82.H05.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacggaagggaaagggcagcgtcactctcgttcccaccctcctctcgtagcactctgagcgggctggcaaggcgcatagn

SEQ ID NO: 175896 - DNA, 155 bp, Homo sapiens
  misc_feature: GYAE6OF01EHUYM.51.82.H05.1.454.CMB.1.raw
tcagcgatcgtatacacgaccggtgctcgatttagtcgagctctctcgcgggcacgaccggtgctcgatttagagtgctacgaagagaaagggcagcgtcactctgttcccgccctcctctcgtagcactctgagcgggctggcaaggcgcatag

SEQ ID NO: 175897 - DNA, 155 bp, Homo sapiens
  misc_feature: GYAE6OF01EPEZP.51.82.H05.1.454.CMB.1.raw
tcagcgatcgtatacacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatag

SEQ ID NO: 175898 - DNA, 751 bp, Homo sapiens
  misc_feature: GYAE6OF01B6FIK.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcacgcccgccctcagtgtccgtcggggccccagggcagacgggtcaccatcctcctgacacgtggggaactacgttaccaacgacggtccggggactaagggttaactaagtgtaacctacgtacggtaaccaggtacctaacctttaccgaacggaaccaccgaacccccctaaaactccctacaacgtacccaatacggtaactaaccgaacgtaaacgtcccgggtacccggttaccgggggtaccctacgggacccttacgtttccgtccgttacggtaccttacccgtaaaggttcctacggtaactacccgtttaccgaacccggttccccgttacccgtcgggacccttacgttacccgtaaccggttccggggtaccctaccggaacgtaccggttacgggaacgggtacgtacggtacgggtacttacggtaactttacgtaccgtcgaccgttacgtacccttagtaccgacgtacgacgtagtccgtacgacgtcgttccggttaggtttcggggttaccggccgggtaccggtactaacgtccgtccggtaccggtcgtaaccgg

SEQ ID NO: 175899 - DNA, 166 bp, Homo sapiens
  misc_feature: GYAE6OF01CJTEC.51.82.H05.1.454.CMB.1.raw
  modified_base (166)..(166): a, c, t, g, unknown or other
  misc_feature (166)..(166): n is a, c, g, or t
tcagcgatcgtatacacgaccggtgctcgatttagtcgagctctctcgcgggcacgaccggtgctcgatttagtcacgcgagaaagggaaagggggctggtcctgacgtgtttctgttcccgccctcctctcgtagcactctgagcgggctggcaaggcgcatagn

SEQ ID NO: 175900 - DNA, 163 bp, Homo sapiens
  misc_feature: GYAE6OF01D2OZG.51.82.H05.1.454.CMB.1.raw
  modified_base (153)..(153): a, c, t, g, unknown or other
  misc_feature (153)..(153): n is a, c, g, or t
  modified_base (159)..(163): a, c, t, g, unknown or other
  misc_feature (159)..(163): n is a, c, g, or t
tcagcgatcgtatacacgaccggtgctcgatttagtcgagctctctcgcgggcacgaccggtgctcgatttagagtgctacgaagggaaagggcagcgtcactctgttccccacccttcctctcgtagcactctgaggcgggctggcaaggcncaatgnnnnn

SEQ ID NO: 175901 - DNA, 318 bp, Homo sapiens
  misc_feature: GYAE6OF01EQ898.51.82.H05.1.454.CMB.1.raw
  modified_base (148)..(148): a, c, t, g, unknown or other
  misc_feature (148)..(148): n is a, c, g, or t
  modified_base (190)..(190): a, c, t, g, unknown or other
  misc_feature (190)..(190): n is a, c, g, or t
  modified_base (289)..(318): a, c, t, g, unknown or other
  misc_feature (289)..(318): n is a, c, g, or t
tcagcgatcgtatacacgaccggtgctcgatttagtcgagctctctcgcgggcacgaccggtgctcgatttagtcgagctctctcggcgggcacgaccggtgctcgtatttagtcgagtctctcgtcggcgggccacggaccggttcncttcgtatttacgctctacgcgtacgagggcgacgaccggtnctcgtactttacgagtcgctagaggaaggcagcgtcgacttcgtgttacccaccctctctcgtagcactgtgacgcgggctgccaggccgtcatggcannnnnnnnnnnnnnnnnnnnnnnnnnnnnn

SEQ ID NO: 175902 - DNA, 198 bp, Homo sapiens
  misc_feature: GYAE6OF01EJ1KM.51.82.H05.1.454.CMB.1.raw
  modified_base (195)..(198): a, c, t, g, unknown or other
  misc_feature (195)..(198): n is a, c, g, or t
tcagcgatcgtatacacgaccggtgctcgatttagtcgagctctctcgcgggcacgaccggtgctcgatttagtcgagctctcgtcggcggcacgaccggtgctcgatttagagtgctacgaagggaaggcagcgtcactcgtcgttcccgccctcctctcgtagcactctgacgcgggctggcaaggctcatgnnnn

SEQ ID NO: 175903 - DNA, 203 bp, Homo sapiens
  misc_feature: GYAE6OF01BMPKY.51.82.H05.1.454.CMB.1.raw
  modified_base (190)..(190): a, c, t, g, unknown or other
  misc_feature (190)..(190): n is a, c, g, or t
  modified_base (196)..(203): a, c, t, g, unknown or other
  misc_feature (196)..(203): n is a, c, g, or t
tcagcgatcgtatacacgaccggtgctcgatttagtcgagctctctcgcgggcacgaccggtgctcgatttagtcgagctctctcgcggcacgaccggtgctcgatttaggtcgagctctctcgcggcacgccgtgctcggatttggcaaggctacttcctcgtagcactctgagcgggctggcaaggcncatagnnnnnnnn

SEQ ID NO: 175904 - DNA, 771 bp, Homo sapiens
  misc_feature: GYAE6OF01CDLP8.51.82.H05.1.454.CMB.1.raw
  modified_base (258)..(258): a, c, t, g, unknown or other
  misc_feature (258)..(258): n is a, c, g, or t
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacgagggtcctgggcccagtctgtactgacgcacgcccgccctgagtcgtccgtcggggcccccaggggccaggacgggtaccacctatcctcctgaccgacgtggggaaaccngttacccaacgacgtccggggactaggttaataacgtcgtaacacgtcggtaccagcctaacttccgaaggaccaccgaccccctaactcctacactacctatacgaactaaccgaacgtaaaccgtccggggtaccccggttccggggtccctacgtaacccggtacgtttccgtccggttaccgacccgttacccgtaaacggttcccgtacgtaaacccgttaaccctttaccgaacccgttcccccgttccccggttaccggtaccctaaccgtaccccgtaaccggttcccgggtaccttaacccggaacgttaccggtaggaacggtacgtacgggtacgttaccgttaacggtaaccgtttacgttaaccgtaccggtacccgtacgttaccgttaacgtacgacgtacgcggaacggtcctaggaccgttcgttcggttgggttcggtttcccggggacgggtacccggtacggtacggtaccgtccggttaccgtcggtaccgg

SEQ ID NO: 175905 - DNA, 193 bp, Homo sapiens
  misc_feature: GYAE6OF01CAFBW.51.82.H05.1.454.CMB.1.raw
  modified_base (185)..(185): a, c, t, g, unknown or other
  misc_feature (185)..(185): n is a, c, g, or t
  modified_base (191)..(193): a, c, t, g, unknown or other
  misc_feature (191)..(193): n is a, c, g, or t
tcagcgatcgtatacacgaccggtgctcgatttagtcgagctctctcgcgggcacgaccggtgctcgatttagtcgagctctctcgcgggcagaccggtgctcgatttagagtgctacgaagggaaaggcagcgtcactctgttcccgccctcctctcgtagcactctgagcggctggcaaggcncatagnnn

SEQ ID NO: 175906 - DNA, 123 bp, Homo sapiens
  misc_feature: GYAE6OF02H5CA9.51.82.H05.1.454.CMB.1.raw
  modified_base (123)..(123): a, c, t, g, unknown or other
  misc_feature (123)..(123): n is a, c, g, or t
tcagcgatcgtatacacgaccggtgctcgatttagtcgagctctctcgcggcacgaccggtgctcgatttggtcaaggactacttcctcgtagcactctgagcgggctggcaaggcgcatagn

SEQ ID NO: 175907 - DNA, 154 bp, Homo sapiens; identical to SEQ ID NO: 175841
  misc_feature: GYAE6OF02IDR7I.51.82.H05.1.454.CMB.1.raw
  modified_base (154)..(154): a, c, t, g, unknown or other
  misc_feature (154)..(154): n is a, c, g, or t

SEQ ID NO: 175908 - DNA, 164 bp, Homo sapiens
  misc_feature: GYAE6OF02GBDLJ.51.82.H05.1.454.CMB.1.raw
  modified_base (164)..(164): a, c, t, g, unknown or other
  misc_feature (164)..(164): n is a, c, g, or t
tcagcgatcgtatacacgaccggtgctcgatttagtcgagctctctcgcgggctctcgcgggcacgaccggtgctcgatttagagtgctacgaagggaagggcagcgtcactctgttcccacctcctctcgtagcactctgagcgggctggcaaggcgcatagn

SEQ ID NO: 175909 - DNA, 148 bp, Homo sapiens
  misc_feature: GYAE6OF02GN9B4.51.82.H05.1.454.CMB.1.raw
  modified_base (147)..(148): a, c, t, g, unknown or other
  misc_feature (147)..(148): n is a, c, g, or t
tcagcgatcgtatacacgaccggtgctcgatttagtcgagctctctcgcgggtgctcgatttagagtgctacgaagggaaagggcagcgtcactctgttcccgccctcctctcgtagcactctgagcgggctggcaaggcgcatagnn

SEQ ID NO: 175910 - DNA, 154 bp, Homo sapiens
  misc_feature: GYAE6OF02H9KCT.51.82.H05.1.454.CMB.1.raw
  modified_base (125)..(154): a, c, t, g, unknown or other
  misc_feature (125)..(154): n is a, c, g, or t
tcagcgatcgtatacacgaccggtgctcgatttagtcgagctctctcgcgggcacgaccggtgctcgatttggtcaaggactacttcctcgtagcactctgagcgggctggcaaggcgcatagcnnnnnnnnnnnnnnnnnnnnnnnnnnnnnn

SEQ ID NO: 175911 - DNA, 155 bp, Homo sapiens; identical to SEQ ID NO: 175842
  misc_feature: GYAE6OF02GSCSD.51.82.H05.1.454.CMB.1.raw
  modified_base (155)..(155): a, c, t, g, unknown or other
  misc_feature (155)..(155): n is a, c, g, or t

SEQ ID NO: 175912 - DNA, 193 bp, Homo sapiens
  misc_feature: GYAE6OF02FQ58O.51.82.H05.1.454.CMB.1.raw
  modified_base (192)..(193): a, c, t, g, unknown or other
  misc_feature (192)..(193): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaaggaagggcagcgtcactctgttcccaccctcctctcgtagcactctgagcgggctggcaaggcgcatagnn

SEQ ID NO: 175913 - DNA, 155 bp, Homo sapiens
  misc_feature: GYAE6OF02HMD1K.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctcctctgtagcactctgagcgggctggcaaggcgcatagn

SEQ ID NO: 175914 - DNA, 156 bp, Homo sapiens; identical to SEQ ID NO: 175859
  misc_feature: GYAE6OF02GMSL2.51.82.H05.1.454.CMB.1.raw
  modified_base (156)..(156): a, c, t, g, unknown or other
  misc_feature (156)..(156): n is a, c, g, or t

SEQ ID NO: 175915 - DNA, 164 bp, Homo sapiens
  misc_feature: GYAE6OF02HKMR2.51.82.H05.1.454.CMB.1.raw
  modified_base (156)..(164): a, c, t, g, unknown or other
  misc_feature (156)..(164): n is a, c, g, or t
tcagcgatcgtatacacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagnnnnnnnnn

SEQ ID NO: 175916 - DNA, 160 bp, Homo sapiens
  misc_feature: GYAE6OF02G7UYK.51.82.H05.1.454.CMB.1.raw
  modified_base (156)..(160): a, c, t, g, unknown or other
  misc_feature (156)..(160): n is a, c, g, or t
tcagcgatcgtatacacgaccggtgctcgatttagtcgagctctctcgcgggcacgaccggtgctcgatttagctacgctctaagggaaagggcagcgtcactctgttcccaccctcctctcgtagcactctgagcgggctggcaaggcgcatagnnnnn

SEQ ID NO: 175917 - DNA, 166 bp, Homo sapiens
  misc_feature: GYAE6OF02HSKPK.51.82.H05.1.454.CMB.1.raw
  modified_base (166)..(166): a, c, t, g, unknown or other
  misc_feature (166)..(166): n is a, c, g, or t
tcagcgatcgtatacacgaccggtgctcgatttagtcgagctctctcgcggtctctcgcgggcacgaccggtgctcgatttagagtgctacgaagggaaagggcagcgtcactctgttcccaccctcctctcgtagcactctgagcgggctggcaaggcgcatagn

SEQ ID NO: 175918 - DNA, 195 bp, Homo sapiens; identical to SEQ ID NO: 175890
  misc_feature: GYAE6OF02FXTEB.51.82.H05.1.454.CMB.1.raw
  modified_base (193)..(195): a, c, t, g, unknown or other
  misc_feature (193)..(195): n is a, c, g, or t

SEQ ID NO: 175919 - DNA, 125 bp, Homo sapiens
  misc_feature: GYAE6OF02HCKL9.51.82.H05.1.454.CMB.1.raw
  modified_base (125)..(125): a, c, t, g, unknown or other
  misc_feature (125)..(125): n is a, c, g, or t
tcagcgatcgtatacacgaccggtgctcgatttagtcgagctctctcgcgggcacgaccggtgctcgatttggtctaggactctggggtacgcactcgtctgagcgggctggcaaggcgcatagn

SEQ ID NO: 175920 - DNA, 155 bp, Homo sapiens; identical to SEQ ID NO: 175842
  misc_feature: GYAE6OF02F06ZC.51.82.H05.1.454.CMB.1.raw
  modified_base (155)..(155): a, c, t, g, unknown or other
  misc_feature (155)..(155): n is a, c, g, or t

SEQ ID NO: 175921 - DNA, 198 bp, Homo sapiens
  misc_feature: GYAE6OF02G838S.51.82.H05.1.454.CMB.1.raw
  modified_base (197)..(198): a, c, t, g, unknown or other
  misc_feature (197)..(198): n is a, c, g, or t
tcagcgatcgtatacacgaccggtgctcgatttagtcgagctctctcgcgggcacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnn

SEQ ID NO: 175922 - DNA, 155 bp, Homo sapiens
  misc_feature: GYAE6OF02FX3F1.51.82.H05.1.454.CMB.1.raw
  modified_base (155)..(155): a, c, t, g, unknown or other
  misc_feature (155)..(155): n is a, c, g, or t
tcagcgatcgtatacacgaccggtgctcgatttagtcgagctctctcgcgggcacgaccggtgctcgatttagagtgctacgaagggaagggcagcgtcactctgttcccgccctcctcttgtagcactctgagcgggctggcaaggcgcatagn

SEQ ID NO: 175923 - DNA, 234 bp, Homo sapiens
  misc_feature: GYAE6OF02GFD6K.51.82.H05.1.454.CMB.1.raw
  modified_base (231)..(234): a, c, t, g, unknown or other
  misc_feature (231)..(234): n is a, c, g, or t
tcagcgatcgtatacacgaccggtgctcgatttagtcgagctctctcgcgggcacgaccggtgctcgatttagtcgagctctctcgcgggcacgaccggtgctcgatttagtccgagctctctcgacgggcacgaccggtgctcgatttagctagtcactcaaggaaggcagcgtcactctgttcccacctcctctcgtagcactctgagcgggctggcaaggcgcatagnnnn

SEQ ID NO: 175924 - DNA, 205 bp, Homo sapiens
  misc_feature: GYAE6OF02HK0DO.51.82.H05.1.454.CMB.1.raw
  modified_base (191)..(205): a, c, t, g, unknown or other
  misc_feature (191)..(205): n is a, c, g, or t
tcagcgatcgtatacacgaccggtgctcgatttagtcgagctctctcgcgggcacgaccggtgctcgatttagctctacgctcagggcacgaccggtgctcgatttagagtgctacgaagggaaaggcagcgtcactctgttcccgccctcctctcgtacgcactctgagcgggctggcaaggcgcatagnnnnnnnnnnnnnnn

SEQ ID NO: 175925 - DNA, 157 bp, Homo sapiens; identical to SEQ ID NO: 175865
  misc_feature: GYAE6OF02JD2GC.51.82.H05.1.454.CMB.1.raw
  modified_base (156)..(157): a, c, t, g, unknown or other
  misc_feature (156)..(157): n is a, c, g, or t

SEQ ID NO: 175926 - DNA, 194 bp, Homo sapiens
  misc_feature: GYAE6OF02GD9UP.51.82.H05.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagn

SEQ ID NO: 175927 - DNA, 157 bp, Homo sapiens; identical to SEQ ID NO: 175835
  misc_feature: GYAE6OF02HWA49.51.82.H05.1.454.CMB.1.raw
  modified_base (156)..(157): a, c, t, g, unknown or other
  misc_feature (156)..(157): n is a, c, g, or t

SEQ ID NO: 175928 - DNA, 278 bp, Homo sapiens
  misc_feature: GYAE6OF02GAGDU.51.82.H05.1.454.CMB.1.raw
  modified_base (271)..(278): a, c, t, g, unknown or other
  misc_feature (271)..(278): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagtcgagctctctacgcgggcacgaccggtgctcgatttagagtgctacgaagggaaagggcagcgtcactctgttcccaccctcctctcgtagcactctgagcgggctggcaaggcgcatagnnnnnnnn

SEQ ID NO: 175929 - DNA, 157 bp, Homo sapiens
  misc_feature: GYAE6OF02F40MR.51.82.H05.1.454.CMB.1.raw
  modified_base (156)..(157): a, c, t, g, unknown or other
  misc_feature (156)..(157): n is a, c, g, or t
tcagcgatcgtatacacgaccggtgctcgatttagtcgagctctctcgcgggcacgaccggtgctcgatttagtgtagtgtgaagggaaagggcagcgtcactctgttcccaccctcctctcgtagcactctgagcgggctggcaaggcgcatagnn

SEQ ID NO: 175930 - DNA, 158 bp, Homo sapiens; identical to SEQ ID NO: 175851
  misc_feature: GYAE6OF02HNNSZ.51.82.H05.1.454.CMB.1.raw
  modified_base (156)..(158): a, c, t, g, unknown or other
  misc_feature (156)..(158): n is a, c, g, or t

SEQ ID NO: 175931 - DNA, 196 bp, Homo sapiens
  misc_feature: GYAE6OF02HA2BM.51.82.H05.1.454.CMB.1.raw
  modified_base (194)..(196): a, c, t, g, unknown or other
  misc_feature (194)..(196): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagnnn

SEQ ID NO: 175932 - DNA, 232 bp, Homo sapiens
  misc_feature: GYAE6OF02GF25F.51.82.H05.1.454.CMB.1.raw
  modified_base (228)..(232): a, c, t, g, unknown or other
  misc_feature (228)..(232): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctcgcggcacgaccggtgctcgatttagagtgctacgaaggaaaggcagcgtcactctgttcccgcctcctctcgtagcactctgagcgggctggcaaggcgcatagnnnnn

SEQ ID NO: 175933 - DNA, 156 bp, Homo sapiens; identical to SEQ ID NO: 175843
  misc_feature: GYAE6OF02HRQXG.51.82.H05.1.454.CMB.1.raw
  modified_base (156)..(156): a, c, t, g, unknown or other
  misc_feature (156)..(156): n is a, c, g, or t

SEQ ID NO: 175934 - DNA, 219 bp, Homo sapiens
  misc_feature: GYAE6OF02I9EPM.51.82.H05.1.454.CMB.1.raw
  modified_base (202)..(219): a, c, t, g, unknown or other
  misc_feature (202)..(219): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctcgcggctggcaaggcgcatagctgcctggtcaaggactacttcctcgtagcactctgagcgggctggcaaggcgcatagnnnnnnnnnnnnnnnnnn

SEQ ID NO: 175935 - DNA, 167 bp, Homo sapiens
  misc_feature: GYAE6OF02H848K.51.82.H05.1.454.CMB.1.raw
  modified_base (155)..(167): a, c, t, g, unknown or other
  misc_feature (155)..(167): n is a, c, g, or t
tcagcgatcgtatacacgaccggtgctcgatttagtcgagctctctcgcggtcacgaccggtgctcgatttagagtgctacgaagggaaagggcagcgtcactctgttcccgcctcctctcgtagcactctgagcgggctggcaaggcgcatagnnnnnnnnnnnnn

SEQ ID NO: 175936 - DNA, 156 bp, Homo sapiens; identical to SEQ ID NO: 175843
  misc_feature: GYAE6OF02FQEA3.51.82.H05.1.454.CMB.1.raw
  modified_base (156)..(156): a, c, t, g, unknown or other
  misc_feature (156)..(156): n is a, c, g, or t

SEQ ID NO: 175937 - DNA, 193 bp, Homo sapiens
  misc_feature: GYAE6OF02I0K37.51.82.H05.1.454.CMB.1.raw
  modified_base (188)..(193): a, c, t, g, unknown or other
  misc_feature (188)..(193): n is a, c, g, or t
tcagcgatcgtatacacgaccggtgctcgatttagtcgagctctctcgcgggcacgaccggtgctcgatttagtcgagctctctcgcggcacgaccggtgctcgattagcgtgctacgaggaaggcagcgtcgactctggttcccacctcctctcgtagcactctgagcggtctggcaaggcgcatgnnnnnn

SEQ ID NO: 175938 - DNA, 236 bp, Homo sapiens
  misc_feature: GYAE6OF02FQ1ZR.51.82.H05.1.454.CMB.1.raw
  modified_base (232)..(236): a, c, t, g, unknown or other
  misc_feature (232)..(236): n is a, c, g, or t
tcagcgatcgtatacacgaccggtgctcgatttagtcgagctctctcgcgggcacgaccggtgctcgatttagctctacgctcagggcacgaccggtgctcgatttagagtgctacgaagggaaagggcacgaccggtgctcgatttagagtgctacgaagggaaagggcagcgtcactctgttcccgccctcctctcgtagcactctgagcgggctggcaaggcgcatagnnnnn

SEQ ID NO: 175939 - DNA, 195 bp, Homo sapiens
  misc_feature: GYAE6OF02GK3K9.51.82.H05.1.454.CMB.1.raw
  modified_base (194)..(195): a, c, t, g, unknown or other
  misc_feature (194)..(195): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagnn

SEQ ID NO: 175940 - DNA, 158 bp, Homo sapiens
  misc_feature: GYAE6OF02GHHJH.51.82.H05.1.454.CMB.1.raw
  modified_base (156)..(158): a, c, t, g, unknown or other
  misc_feature (156)..(158): n is a, c, g, or t
tcagcgatcgtatacacgaccggtgctcgatttagtcgagctctctcgcgggcacgaccggtgctcgatttagagtgctacgaagggaaagggcagcgtcactctgttcccacccttctctcgtagcactctgagcgggctggcaaggcgcatagnnn

SEQ ID NO: 175941 - DNA, 156 bp, Homo sapiens
  misc_feature: GYAE6OF02F9SIP.51.82.H05.1.454.CMB.1.raw
tcagcgatcgtatacacgaccggtgctcgatttagtcgagctctctcgcgggcacgaccggtgctcgatttagtcacgcgagaaagggaaagggcagcgtcactctgttcccaccctcctctcgtagcactctgagcgggctggcaaggcgcatag

SEQ ID NO: 175942 - DNA, 234 bp, Homo sapiens
  misc_feature: GYAE6OF02GVGNA.51.82.H05.1.454.CMB.1.raw
  modified_base (230)..(234): a, c, t, g, unknown or other
  misc_feature (230)..(234): n is a, c, g, or t
tcagcgatcgtatacacgaccggtgctcgatttagtcgagctctctcgcgggcacgaccggtgctcgatttagtcgagctctctcgcgggcacgaccggtgctcgatttagacagtatatatccgcggcacgaccggtgctcgatttagagtgctacgaagggaaggcagcgtcactctgttcccaccctcctctcgtagcactctgagcgggctggcaaggcgcatagnnnnn

SEQ ID NO: 175943 - DNA, 498 bp, Homo sapiens
  misc_feature: GYAE6OF02H15RC.51.82.H05.1.454.CMB.1.raw
  modified_base (353)..(353): a, c, t, g, unknown or other
  misc_feature (353)..(353): n is a, c, g, or t
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggcccccagggcagagggtcaccatctcctgcactgggaacagttccaacatcggggcaggttataatgtacactggtaccagcaacttccaggaacacgcccccaaactcctcatccatgataccagaaatcggccctcgggggtcctgaccgattcnctggctcaagtctgacacttcagccctccctggccatcacgtcggctccagactgagatgagctgactattactgcctagtcctatcgacagcagctgactgcgtgtcggtttcggcggcggacaagctacgtaccgtcgtacgg

SEQ ID NO: 175944 - DNA, 156 bp, Homo sapiens; identical to SEQ ID NO: 175843
  misc_feature: GYAE6OF02GA0L1.51.82.H05.1.454.CMB.1.raw
  modified_base (156)..(156): a, c, t, g, unknown or other
  misc_feature (156)..(156): n is a, c, g, or t

SEQ ID NO: 175945 - DNA, 165 bp, Homo sapiens
  misc_feature: GYAE6OF02F45IN.51.82.H05.1.454.CMB.1.raw
  modified_base (156)..(165): a, c, t, g, unknown or other
  misc_feature (156)..(165): n is a, c, g, or t
tcagcgatcgtatacacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagnnnnnnnnnn

SEQ ID NO: 175946 - DNA, 156 bp, Homo sapiens; identical to SEQ ID NO: 175843
  misc_feature: GYAE6OF02F3Y0G.51.82.H05.1.454.CMB.1.raw
  modified_base (156)..(156): a, c, t, g, unknown or other
  misc_feature (156)..(156): n is a, c, g, or t

SEQ ID NO: 175947 - DNA, 157 bp, Homo sapiens
  misc_feature: GYAE6OF02FXSMP.51.82.H05.1.454.CMB.1.raw
  modified_base (156)..(157): a, c, t, g, unknown or other
  misc_feature (156)..(157): n is a, c, g, or t
tcagcgatcgtatacacgaccggtgctcgatttagtcgagctctctcgcgggacgaccggtgctcgatttagtcacgcgagaaagggaaagggcagcgtcactctgttcccgccctcctctcgtagcactctgagcgggctggcaaggcgcatagnn

SEQ ID NO: 175948 - DNA, 184 bp, Homo sapiens
  misc_feature: GYAE6OF02G3SIS.51.82.H05.1.454.CMB.1.raw
  modified_base (157)..(184): a, c, t, g, unknown or other
  misc_feature (157)..(184): n is a, c, g, or t
tcagcgatcgtatacacgaccggtgctcgatttagtcgagctctctcgcgggcacgaccggtgtctcgatttagagtgctacgaagggaaagggcagcgtcactctgttcccaccctcctctcggtacactctgagcgggctggcaaggcgcatagnnnnnnnnnnnnnnnnnnnnnnnnnnnn

SEQ ID NO: 175949 - DNA, 159 bp, Homo sapiens
  misc_feature: GYAE6OF02IX08E.51.82.H05.1.454.CMB.1.raw
  modified_base (155)..(159): a, c, t, g, unknown or other
  misc_feature (155)..(159): n is a, c, g, or t
tcagcgatcgtatacacgaccggtgctcgatttagtcgagctctctcgcgggcacgaccggtgctcgatttagagtgctacgaagggaaagggcagcgtcactctgttcccacctcctctcgtagcactctgagcgggctggcaaggcgcatagnnnnn

SEQ ID NO: 175950 - DNA, 156 bp, Homo sapiens; identical to SEQ ID NO: 175859
  misc_feature: GYAE6OF02HCD9U.51.82.H05.1.454.CMB.1.raw
  modified_base (156)..(156): a, c, t, g, unknown or other
  misc_feature (156)..(156): n is a, c, g, or t

SEQ ID NO: 175951 - DNA, 194 bp, Homo sapiens
  misc_feature: GYAE6OF02ITC0J.51.82.H05.1.454.CMB.1.raw
  modified_base (192)..(194): a, c, t, g, unknown or other
  misc_feature (192)..(194): n is a, c, g, or t
tcagcgatcgtatacacgaccggtgctcgatttagtcgagctctctcgcgggcacgaccggtgctcgatttagctacgctctaagggcacgaccggtgctcgatttagtctgacgtcaaagggaaagggcagcgtcactctgttcccaccctcctctcgtagcactctgagcgggctggcaaggcgcatagnnn

SEQ ID NO: 175952 - DNA, 240 bp, Homo sapiens
  misc_feature: GYAE6OF02JQW92.51.82.H05.1.454.CMB.1.raw
  modified_base (228)..(228): a, c, t, g, unknown or other
  misc_feature (228)..(228): n is a, c, g, or t
  modified_base (234)..(240): a, c, t, g, unknown or other
  misc_feature (234)..(240): n is a, c, g, or t
tcagcgatcgtatacacgaccggtgctcgatttagtcgagctctctcgcgggcacgaccggtgctcgatttagtgtgagtagttccgcgggcacgaccggtgctcgatttagtgtgagtagttccgcgggcacgaccggtgctcgatttagagtgctacgaagggaaagggcagcgtcactctgttcccaccctcctctcgtagcactctgagcgggctggcaaggcncatagnnnnnnn

SEQ ID NO: 175953 - DNA, 125 bp, Homo sapiens
  misc_feature: GYAE6OF02HJ0I9.51.82.H05.1.454.CMB.1.raw
  modified_base (124)..(125): a, c, t, g, unknown or other
  misc_feature (124)..(125): n is a, c, g, or t
tcagcgatcgtatacacgaccggtgctcgatttagtcgagctctctcgcgggcacgaccggtgctcgatttggtcaaggactacttcctcgtagcactctgagcgggctggcaaggcgcatagnn

SEQ ID NO: 175954 - DNA, 158 bp, Homo sapiens; identical to SEQ ID NO: 175837
  misc_feature: GYAE6OF02H1T0P.51.82.H05.1.454.CMB.1.raw
  modified_base (157)..(158): a, c, t, g, unknown or other
  misc_feature (157)..(158): n is a, c, g, or t

SEQ ID NO: 175955 - DNA, 155 bp, Homo sapiens; identical to SEQ ID NO: 175834
  misc_feature: GYAE6OF02IKBKN.51.82.H05.1.454.CMB.1.raw
  modified_base (155)..(155): a, c, t, g, unknown or other
  misc_feature (155)..(155): n is a, c, g, or t

SEQ ID NO: 175956 - DNA, 156 bp, Homo sapiens; identical to SEQ ID NO: 175843
  misc_feature: GYAE6OF02FRT5Z.51.82.H05.1.454.CMB.1.raw
  modified_base (156)..(156): a, c, t, g, unknown or other
  misc_feature (156)..(156): n is a, c, g, or t

SEQ ID NO: 175957 - DNA, 197 bp, Homo sapiens
  misc_feature: GYAE6OF02G333R.51.82.H05.1.454.CMB.1.raw
  modified_base (193)..(197): a, c, t, g, unknown or other
  misc_feature (193)..(197): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaaggcagcgtcactctgttcccgccctcctctcgtagcactctgagcgggctggcaaggcgcatagnnnnn

SEQ ID NO: 175958 - DNA, 156 bp, Homo sapiens; identical to SEQ ID NO: 175859
  misc_feature: GYAE6OF02F25SP.51.82.H05.1.454.CMB.1.raw
  modified_base (156)..(156): a, c, t, g, unknown or other
  misc_feature (156)..(156): n is a, c, g, or t

SEQ ID NO: 175959 - DNA, 223 bp, Homo sapiens
  misc_feature: GYAE6OF02HU2O9.51.82.H05.1.454.CMB.1.raw
  modified_base (219)..(223): a, c, t, g, unknown or other
  misc_feature (219)..(223): n is a, c, g, or t
tcagcgatcgtatacacgaccggtgctcgatttagtcgagctctctcgcgggcacgaccggtgctcgatttagtcgagctctctcgcgggctcgatttagtcgagctctctcgcgggcacgaccggtgctcgatttagagtgctacgaagggaaaggcagcgtcactctgttcccaccctctctcgtagcactctgagcgggctggcaaggcgcatagnnnnn

SEQ ID NO: 175960 - DNA, 162 bp, Homo sapiens
  misc_feature: GYAE6OF02JE9SY.51.82.H05.1.454.CMB.1.raw
  modified_base (155)..(162): a, c, t, g, unknown or other
  misc_feature (155)..(162): n is a, c, g, or t
tcagcgatcgtatacacgaccggtgctcgatttagtcgagctctctcgcgggcacgaccggtgctcgatttagagtgctacgaagggaaaggcagcgtcactctgttcccaccctcctctcgtagcactctgagcgggctggcaaggcgcatagnnnnnnnn

SEQ ID NO: 175961 - DNA, 157 bp, Homo sapiens
  misc_feature: GYAE6OF02GGAB8.51.82.H05.1.454.CMB.1.raw
  modified_base (157)..(157): a, c, t, g, unknown or other
  misc_feature (157)..(157): n is a, c, g, or t
tcagcgatcgtatacacgaccggtgctcgatttagtcgagctctctcgcgggcacgaccggtgctcgatttagtcacgcgagaaagggaaagggcagcgtcactctgttcccgccctcctctcgtagcactctgagcgggctggcaaggcgcatagn

SEQ ID NO: 175962 - DNA, 111 bp, Homo sapiens
  misc_feature: GYAE6OF02JI432.51.82.H05.1.454.CMB.1.raw
  modified_base (107)..(111): a, c, t, g, unknown or other
  misc_feature (107)..(111): n is a, c, g, or t
tcagcgatcgtatacacgaccggtgctcgatttagtcgagctctctcgcgggcacgaccggtgctcgatttagtcgagctctctcgcgggctggcaaggcgcatagnnnnn

SEQ ID NO: 175963 - DNA, 195 bp, Homo sapiens
  misc_feature: GYAE6OF02FLR7D.51.82.H05.1.454.CMB.1.raw
  modified_base (192)..(195): a, c, t, g, unknown or other
  misc_feature (192)..(195): n is a, c, g, or t
tcagcgatcgtatacacgaccggtgctcgatttagtcgagctctctcgcgggcacgaccggtgctcgatttagctctacgctcagggcacgaccggtgctcgatttagctgtgcgtcgaagggaaagggcagcgtcactctgttcccgccctcctctcgtagcactctgagcgggctggcaaggcgcatagnnnn

SEQ ID NO: 175964 - DNA, 194 bp, Homo sapiens
  misc_feature: GYAE6OF02FMQ7Q.51.82.H05.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatagn

SEQ ID NO: 175965 - DNA, 698 bp, Homo sapiens
  misc_feature: GYAE6OF02IME4E.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagccgccctcagtgtctcggggccccagggcagagggtcaccatctcctgcacgtgggaacagttccaacagtcggggcaggttataatgtacacgtggtaccagtacaacttccgaggaacacgacccccaaactcctcactccatcgaataccaagaaactccggcccgtccgggggtccctcgacccgtattctcgtcggcctaccgaagtctacgacctacttccacgtcccttcccgtcggaccctacgttacccgtaccgtcggggacccttacccgtaacggtaaccgttacgggaacggtacgttagggaacgggtccgtacggtaaccttaagtttaccgtccggtaccctacgttacccgtaagttacggaacgtacgaccgtacggtaccgttacggtaccgttcgggtccggtttacggggttttcggggttttcccggggaccggggttacccgggggtaacctaaccgggtccggttacccgggtaccccggttacccggttaaccggg

SEQ ID NO: 175966 - DNA, 205 bp, Homo sapiens
  misc_feature: GYAE6OF02H73TI.51.82.H05.1.454.CMB.1.raw
  modified_base (188)..(189): a, c, t, g, unknown or other
  misc_feature (188)..(189): n is a, c, g, or t
  modified_base (191)..(205): a, c, t, g, unknown or other
  misc_feature (191)..(205): n is a, c, g, or t
tcagcgatcgtatacacgaccggtgctcgatttagtcgagctctctcgcgggcacgaccggtgctcgatttagctctacgctcagggcacgaccggtgctcgatttagagtgctacgaagggaaaggcagcgtcactctgttcccaccctctctcgtagcatctgagcgggctggcaaggcgcatagnncnnnnnnnnnnnnnnn

SEQ ID NO: 175967 - DNA, 511 bp, Homo sapiens
  misc_feature: GYAE6OF02FZYFI.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacaggtcctgggcccagtctgtactgacgcagccgccctcagtgtctggggcccccagggcagagggtcaccatctcctgcactgggaacagttccaacatcggggcaggttataatgtacactggtaccagcaacttccaggaacacgcccccaaactcctcatccatgataccagaaaatcggccctcgggggtccctgaccgattctctggctccaagtctgacacttcacgcctccctggccatcactgggctcccagactgaggatgaggctgactattactgcctagtcctatgacagcgagctgactgcttggtacggttttcggcggtccgggaccaacggctcggaccgtccgtacgg

SEQ ID NO: 175968 - DNA, 195 bp, Homo sapiens
  misc_feature: GYAE6OF02IVWZT.51.82.H05.1.454.CMB.1.raw
  modified_base (192)..(195): a, c, t, g, unknown or other
  misc_feature (192)..(195): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaaggcagcgtcactctgttcccgcctcctctcgtagcactctgagcgggctggcaaggcgcatagnnnn

SEQ ID NO: 175969 - DNA, 145 bp, Homo sapiens
  misc_feature: GYAE6OF02GWF91.51.82.H05.1.454.CMB.1.raw
  modified_base (143)..(145): a, c, t, g, unknown or other
  misc_feature (143)..(145): n is a, c, g, or t
tcagcgatcgtatacacgaccggtgctcgatttagtcgagctctctcgcggcacgaccggtgctcgatttagtcgagctctctcgcgggcacgaccggtgctcgatttagtcgagctccctgcgggctggcaaggcgcatagnnn

SEQ ID NO: 175970 - DNA, 540 bp, Homo sapiens
  misc_feature: GYAE6OF02FYH9P.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacacgacccccaaatcctcactccatgactaccagaaactccggcccgtcgggggtccctggacccgatttctcgtggcctaccgaagtctgacctacttcacgccctccctgccactcactcgggcctccgagactgaggatgagtctgactattacgtcgacctagtcctatcgacagcagctagacgtgtacgttggttcggttttccgggcggtaccgggaccgagtccgtacgtacccgtcgtacgg

SEQ ID NO: 175971 - DNA, 558 bp, Homo sapiens
  misc_feature: GYAE6OF02G1I2I.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcacgtgggaacagttccaacatcggggcaggttataatgtacactggtaccagcaacttccaggaacacgacccccaaactcctcatccatgataccagaaactcggcccgtcgggggtccctgaccgattctctggctccaagtctgacacttcacgccctccctggcccatccactcgggcctccagactggaggatgagtctgactattacgtgacctagtcctatcgacagcgaggtctggaccgtgtccgttgggttacgggttttcccgggacgggtaccgggtaaccgaacggtccgtaccgggtacccgttacgttaacccgggg

SEQ ID NO: 175972 - DNA, 145 bp, Homo sapiens
  misc_feature: GYAE6OF02F61XN.51.82.H05.1.454.CMB.1.raw
  modified_base (144)..(145): a, c, t, g, unknown or other
  misc_feature (144)..(145): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctgcgggctggcaaggcgcatagnn

SEQ ID NO: 175973 - DNA, 196 bp, Homo sapiens
  misc_feature: GYAE6OF02IUYL7.51.82.H05.1.454.CMB.1.raw
  modified_base (193)..(196): a, c, t, g, unknown or other
  misc_feature (193)..(196): n is a, c, g, or t
tcagcgatcgtatacacgaccggtgctcgatttagtcgagctctctcgcgggcacgaccggtgctcgatttagtcgagctctctcgcgggcacgaccggtgctcgatttagagtgctacgaagggaaagggcagcgtcactctgttcccgccctcctctcgtagcactctgagcgggctggcaaggcgcatgnnnn

SEQ ID NO: 175974 - DNA, 156 bp, Homo sapiens
  misc_feature: GYAE6OF02JSIJ2.51.82.H05.1.454.CMB.1.raw
  modified_base (148)..(148): a, c, t, g, unknown or other
  misc_feature (148)..(148): n is a, c, g, or t
  modified_base (154)..(156): a, c, t, g, unknown or other
  misc_feature (154)..(156): n is a, c, g, or t
tcagcgatcgtatacacgaccggtgctcgatttagtcgagctctctcgcgggcacgaccggtgctcgatttagagtgctacgaagggaaagggcagcgtcactctgttcccgcctcctctcgtagcactctgagcgggctggcaggcncatagnnn

SEQ ID NO: 175975 - DNA, 734 bp, Homo sapiens
  misc_feature: GYAE6OF02HC1UI.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagcccgccctcagtgtctcggggccccagggcaggagggtcaccatctcctgcacgtgggaacagttccaacagtcggggcaggttataatgtacacgtggtaccagccaacttccgaggaaccacgacccccaaactcctacactccatgactaccagaaacgtccggcccgtcggggtccctgaccgtattcctcgtcggcctaccgaacgtctacgacctaccttcgacgtccccttcccgtacggtaccctacgttacccgtaccgtccgggtcccttacccggaacggtaccgttacgggaacggggtacgttacggggacgggtccgttaacggtaaccgtttaactttaacccgtccggtaccccgttaacgggttacccctttaagtacggtaaacctaacgggtaccgtaccgggtaccttacggtaccgttcgggttaccggttttggggttttccggggtttttcccgggggaccggggttacccgggggtaacccgtaaacgggttcccgttaacccgggtaccccggttacccggttaacccgggg

SEQ ID NO: 175976 - DNA, 626 bp, Homo sapiens
  misc_feature: GYAE6OF02FUA5N.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccgaggaacacgacccccaaactcctcactccatgaataccagaaactccggcccgtcggggtccctgaccgtattctcgtcggctcctaagtcctgactaccttcacgccctccctggcccatccacgtcgggcctccgactacgtagaggtacgtgacggtctacgtacttacgttaccgtcgacccgtacgttccgtactacgaccgtaggaccgtaggccgttacggaccttcgggtccgtttacggggtttcggggtttttacccggggacccggggtaccgggtacccggtaaacgggtcccgttacccgggtaccccggtttcccggttaacccggg

SEQ ID NO: 175977 - DNA, 236 bp, Homo sapiens
  misc_feature: GYAE6OF02F744B.51.82.H05.1.454.CMB.1.raw
  modified_base (231)..(236): a, c, t, g, unknown or other
  misc_feature (231)..(236): n is a, c, g, or t
tcagcgatcgtatacacgaccggtgctcgatttagtcgagctctctcgcgggcacgaccggtgctcgatttagtcgagctctctcgtgggcacgaccggtgttcgatttagtcgagctctctcgcgggcacgaccggtgctcgatttagagtgctacgaagggaaaggcagcgtcactctgttcccgccctcctctcgtagcactctgagcgggctggcaaggcgcatagnnnnnn

SEQ ID NO: 175978 - DNA, 145 bp, Homo sapiens
  misc_feature: GYAE6OF02HG2OW.51.82.H05.1.454.CMB.1.raw
  modified_base (145)..(145): a, c, t, g, unknown or other
  misc_feature (145)..(145): n is a, c, g, or t
tcagcgatcgtatacacgaccggtgctcgatttagtcgagctctctcgcgggcacgaccggtgctcgatttagtcgagctctctcgcgggcacgaccggtgctcgatttagtcgagctctctcgcgggctggcaaggcgcatagn

SEQ ID NO: 175979 - DNA, 196 bp, Homo sapiens
  misc_feature: GYAE6OF02I14OW.51.82.H05.1.454.CMB.1.raw
  modified_base (186)..(186): a, c, t, g, unknown or other
  misc_feature (186)..(186): n is a, c, g, or t
  modified_base (192)..(196): a, c, t, g, unknown or other
  misc_feature (192)..(196): n is a, c, g, or t
tcagcgatcgtatacacgaccggtgctcgatttagtcgagctctctcgcgggcacgaccggtgctcgatttagctctacggctcagggcacgaccggtgctcgatttagagtgctacgaagggaaagggcagcgtcactctgttcccgccctcctctcgtagcactctgagcgggctggcaaggcncatagnnnnn

SEQ ID NO: 175980 - DNA, 149 bp, Homo sapiens
  misc_feature: GYAE6OF02I0MBA.51.82.H05.1.454.CMB.1.raw
  modified_base (144)..(149): a, c, t, g, unknown or other
  misc_feature (144)..(149): n is a, c, g, or t
tcagcgatcgtatacacgaccggtgctcgatttagtcgagctctctcgcgggcacgaccgggtgctcgatttagtcgagctctctcgcgggcacgaccggtgctcgatttagtcgagctctctgcggctggcaaggcgcatagnnnnnn

SEQ ID NO: 175981 - DNA, 278 bp, Homo sapiens
  misc_feature: GYAE6OF02JW1H6.51.82.H05.1.454.CMB.1.raw
  modified_base (145)..(145): a, c, t, g, unknown or other
  misc_feature (145)..(145): n is a, c, g, or t
  modified_base (239)..(239): a, c, t, g, unknown or other
  misc_feature (239)..(239): n is a, c, g, or t
  modified_base (251)..(278): a, c, t, g, unknown or other
  misc_feature (251)..(278): n is a, c, g, or t
tcagcgatcgtatacacgaccggtgctcgatttagtcgagctctctcgcgggcacgaccggtgctcgatttagtcgagctctctcgcgggcacgaccggtgctcgatttagcgtagcctctacgacggcggacaccggaccggtncgtcgtactttacgacgtgcctacggaagggaaacggtcagcgtcgactcgtcgtacccaccctctctcgtagccatcgtgagccggtgtgganacggctcgatgnnnnnnnnnnnnnnnnnnnnnnnnnnnn

SEQ ID NO: 175982 - DNA, 695 bp, Homo sapiens
  misc_feature: GYAE6OF02JH028.51.82.H05.1.454.CMB.1.raw
  modified_base (237)..(237): a, c, t, g, unknown or other
  misc_feature (237)..(237): n is a, c, g, or t
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcacgtgggaacngttccaacatcggggcaggttataatgtacactggtaccagcaacttccaggaacacgccccaaactcctacatccatgactaccagaaactcggcccgtacgggggcccttcgaccgtacttctacgtggacctacccgaacgttcctacgacctaaccgtttccgaaccgtccccttaccccgttgggacccctacgtcccgtaacgttcggggtacccttcccgaacggtaacccgttagggaacggtaacgttacgggacggtaccgtacgtaacgtttaacttaaccgttacgacccgttaacggttacccttaacgtcggtaaacctaacggtaccaacgggtcttacggaccgttcggtaccgtttcgggtttaccggggttttcccgggaccgggaccggggttacccgaaacggtcccgttacgggtaccccggttcccgttaaccggg

SEQ ID NO: 175983 - DNA, 281 bp, Homo sapiens
  misc_feature: GYAE6OF02G2XTB.51.82.H05.1.454.CMB.1.raw
  modified_base (228)..(228): a, c, t, g, unknown or other
  misc_feature (228)..(228): n is a, c, g, or t
  modified_base (230)..(231): a, c, t, g, unknown or other
  misc_feature (230)..(231): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (241)..(281): a, c, t, g, unknown or other
  misc_feature (241)..(281): n is a, c, g, or t
tcagcgatcgtatacacgaccggtgctcgatttagtcgagctctctcgcgggcacgaccggtgctcgatttagtcgagctctctcgcgggcacgaccggtgctcgatttagctctacgctcagggcacgaccgtgctcgatttagagtgctacgaagggaaaggcagcgtcactctgttcccaccctcctctcgtagcactctgagcgggctggcaaggcgcatagcngnnatncgncgannnnnnnnnnnnnnnnnnnnnnnnnnnnnnnnnnnnnnnnn

SEQ ID NO: 175984 - DNA, 186 bp, Homo sapiens
  misc_feature: GYAE6OF02ISTY9.51.82.H05.1.454.CMB.1.raw
  modified_base (185)..(186): a, c, t, g, unknown or other
  misc_feature (185)..(186): n is a, c, g, or t
tcagcgatcgtatacacgaccggtgctcgatttagtcgagctctctcgcgggcacgaccggtgctcgatttagtcgagctctctcgcgggcacgaccggtgctcgatttagacagtatatatccgcgggcacgaccggtgctcgattttagtcgagctctctcgcgggctggcaaggcgcatagnn

SEQ ID NO: 175985 - DNA, 298 bp, Homo sapiens
  misc_feature: GYAE6OF02FPLS9.51.82.H05.1.454.CMB.1.raw
  modified_base (116)..(116): a, c, t, g, unknown or other
  misc_feature (116)..(116): n is a, c, g, or t
  modified_base (209)..(212): a, c, t, g, unknown or other
  misc_feature (209)..(212): n is a, c, g, or t
  modified_base (214)..(298): a, c, t, g, unknown or other
  misc_feature (214)..(298): n is a, c, g, or t
tcagcgatcgtatacacgaccggtgctcgatttagtcgagctctctcgcgggcgacgaccggtgctcgatttagtcgagcctctcgtcgcgggcaccggccggtgctcgatttagngttgctacggaagggaaagggcagcgtcactctgttccccaccctctctcgtagcactctgagcgggctggcaagggcgcaagtagtcactgnnnngnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 175986 - DNA, 931 bp, Homo sapiens
  misc_feature: GYAE6OF02HUQ5V.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctctcactctcctcgctcactgcacgagggtcctcgggcccagtctgtactcgacgcacgcccgccctacgagtcggtccgtccggggaccccgaggggaccagggacgggtaccaccgtacttccgtccgtcgccgtaacggtaggggaaacctacgttacccgaaacgtcgggtccgggggaacttaagggttttaaacgtaaagttacggttaaccgtaacggtttaccggtaaacccgtaacgtaacccgttaaacccgttaccggaaacggaaacccgtaacccccggtaaacccccgtaaaacctttccctaaccaaccttacccgtaaacgttacgtaaaaccttaaacccggaaaggtaaaccccggttccccgggggtacccggtttacccggggggttacccctaacgggtaccccgttaacttttcccggttaccggttaccgggtacccttaacccggtaccgttacgtacccgttaaaccgtttaccctttacggacccggtttacccccgttacccggtaccggtaaccctaccgttaccggttaccggtaccgggaccttaacccggaagtacggtacggtacggtatacgggacgtactacgtaacttccgtttacgtaccgacgtttaccggttacgtaacggtctaacggaggaccttaccggggtaccttaggttaaccggttccgggttttacgggttcggggtttttaccggggtcccgggggaacgggttacccgggtaaccgtaccggtttacccgggtacccggtttaaccggtccggtaaaccggg

SEQ ID NO: 175987 - DNA, 1055 bp, Homo sapiens
  misc_feature: GYAE6OF02IXV8I.51.82.H05.1.454.CMB.1.raw
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
tcagcgatcgtatacacgaccggtgctcgatttagtcgagctctctcgcgggtctgcttcagctgtggcacaagaggcagcactcaggacaatctccagcatggcctggtctcctctcctcctacactctcctcgctcactgcacgagggtcctgggcccagtctgtactgacgcagccnccctngtcgtcgtcgggccccagggccaggacgggtcaccgtatctccgtgaccacgttacgggaactagtttaccaaactacggtcgggggacctaaggggtttaataaacttcggtaacctacggttacgggttaacccaggtacctaacccgtttaccgaacggtaaacctaccgaaccccccgtaaaacttccctaacctaccttaccctaacgtacggtaacccgttaaacccgtaaaagggtaaaaccggttcccggggtaacccccgggtttacccgggggggttacccccttaacccggggtaaccccggtttaaccggttttaccccgttacggtttacccgggtacccgtttaaccccgtaaacggtttacccggttaccggtaacccgtttaacccgtttaccggtaaaccccggttcccccgtttaaccccggttacgggaacccctttaacccggttacccgttaaccggtttacccggggtacccctttaacccgggtaaaccggtaccggtttaaccggggttaacggggttaaccgtttacggggaaaccgggttcccgtaacggtttaaacccggttttaaaccgtttaccgggtaacccgggtttaacccgtaacccgtttttaacccgtaaacgggttaccgtaaaccggggtaacgtaacccggttaaccggggttacccgtttaaccgggtacccgttttacggttacccggggggttttttaacccgtttcccgggggggttttaccccggggtaccggggttacccccggggttaaaaccggtttcccccggttaacccggggttttacccggttaaacccccccgggggttttcccgttaaacccgggggg

SEQ ID NO: 175988 - DNA, 165 bp, Homo sapiens
  misc_feature: GYAE6OF02GFINW.51.82.H05.1.454.CMB.1.raw
  modified_base (154)..(165): a, c, t, g, unknown or other
  misc_feature (154)..(165): n is a, c, g, or t
tcagcgatcgtatacacgaccggtgctcgatttagtcgagctctctcgcgggcacgaccggtgctcgatttagagtgctacgaagggaaggcagcgtcactctgttcccgccctcctctcgtagcactctgagcgggctggcaaggcgcatagnnnnnnnnnnnn

SEQ ID NO: 175989 - DNA, 872 bp, Homo sapiens
  misc_feature: GYAE6OF02JEA59.51.82.H05.1.454.CMB.1.raw
  modified_base (138)..(138): a, c, t, g, unknown or other
  misc_feature (138)..(138): n is a, c, g, or t
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
tcagcgatcgtatacacgaccggtgctcgatttagtcgagctctctcgcggggtctgcttcagctggtgggcacaagaggcagcactcaggacaatctccagcatggcctggtcctcctctcctctcactctccgtcnctcactcgcacgagggtcctgggccctagtctntactgacgcacggcccncctcagtgtccgtcggggaccccagggcaggacggtcaccatcctcctgtacacgtacgggaacctagttaccaacgacgtcggggtacgtaaggtttaagtaagttacgtaaccgtacggttaccggtaaacccgacggaacccttaaaccgtttaacccggaaacgggaaaacccctaaccccggaaacccccctaaaccctttaccccttaacctaaccttacccctaaggttaaccggtaaacttaaaccccgaacgtaaaaccgggttcccccggtaccccgggttacccggggggtccccgtaacggtaaccgttaccgtttccgttacccggtccggtaaccgtacccgtaacgttccgtacccgttaacccgttaccgtttacccgacccgtttaccccgtcccccggtacgggtaccctaacccgtttacccggtaccgttaccggggttacccctacccggtaacgtaaccggttacggaccggttaaggtccgggtagttaccgtacggttaacctttaccgtaccgtaccgtacctacgttaccgttagtaccgaagacgcgtacgggtctaacggttcggtcggttcggtttacggggttcgggtttcccggggacgggtacccgggtacgtacccgggttggtaaccccgttaccggtcgttaacccggg

SEQ ID NO: 175990 - DNA, 661 bp, Homo sapiens
  misc_feature: GYAE6OF02GOLSH.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacaggtcctgggcccagtctgtactgacgcagccgcctcagtcgtcgtcgggcccccagggcaggaggtccacctagtcctccgtagccacgtacgggaacacgttccaacgagtcggggactaggttaatagtcgtacactgtaccagtacaaccgttaccgaggaaccaccgaccccctaaacctcctaccgactccagtacgaactaaccaggtaaactcccgggtacccggttccgggggtaccctggacccgttatttcccgtcgtcggccttaccagttccgtacgacctacttcaccgtcccttacccgtcggaccctacgtccctaacggtccggtcctacccgacgtacgtacggaggtacgtaggtaacgcgtaacgtaccgttaacttaccttcggtaccgtaccggtacttacgttacgacacgtcgacggtctagtacgtcgtgttccggttcgggttccggccgggtaccgacggtacgtcgtaccgtccggtaccgtaccgg

SEQ ID NO: 175991 - DNA, 787 bp, Homo sapiens
  misc_feature: GYAE6OF02IGGCS.51.82.H05.1.454.CMB.1.raw
tcagcgatcgtatacacgaccggtgctcgatttagtcgagctctctcgcggggtctgcttcagctgtgggcacaagaggcagcactcaggacaatctccagcatggcctggtctcctctcctcctcactctcctcgctcactgcacgacgggtcctgggcccagtctgtactgacgcacgcccgccctcagtcgtcgtcggggccccagggcaggacggtccaccgactcctcctgctacgtcgggaactacgttccaaacagtcggggactaggttaataagttcgtaacacgttcggtaaccagtacctaaccttaccgaacggtaaccaccgacccccctaaactcctacactccaatgaactaccgaagaaacgtccggcccggttaccgggggtccctaggaacccgtatttcgtacgtcggtacctaaccgtaagttccgtacgtaacctacgtttaccgaaccgtcccccgttcccgtaccgggtaccctaacgtcccgtaaccggttaccggggtccttacccgaggtaccgttaggaacggttaacgtcgggtaacggtacgttaacgtaacgttttaacgtttaacccgtcggtaacccgttaacgttacccgtttaacgtaacggaaccgtacgggtaccgtacggtacccgttcggaaccgtttcggtacccgggttttaggggttttacccgggggtttcccgggaaccggggtacccgggtaaaccggtaccgggtacccggtttacgggtaaccccggttcggtaacccggg

SEQ ID NO: 175992 - DNA, 520 bp, Homo sapiens
  misc_feature: GYAE6OF01DVZUN.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagacaaaaaccagggaaagcccctaagctcctgatcctcgatgcatccaatttggaaacagggtcccatcaaggttcagtggaagtggtctgggacagtattttacttcaccatcagcagcctttcaccccttgaaagtacttcttagacctaaactaattaactttaactgtaccaaactagttaatgaattaatcctcccaacttcaactttcgggacggagggacccaagggtggagtatacaaacggtactgtggctcgcaccatctgtcc

SEQ ID NO: 175993 - DNA, 536 bp, Homo sapiens
  misc_feature: GYAE6OF01BD7OA.51.1.A01.1.454.CMB.1.raw
  modified_base (306)..(306): a, c, t, g, unknown or other
  misc_feature (306)..(306): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagacaaaaaccagggaaagcccctaagcctcctgatcctcgatgcatccaatttggaaacngggtcccatcaaggttcagtgcaagtggctctgggacagatttcactttcacatcagcagactgcagcctagaagtatattgacaaactatatttactgtacaactagttatgtaattaactcctcccgcttcctaccgttttcggggaccgggacggggtaacccgaaaggggttcgggggaaacttaccgaaaaccggtaacgtaggttacgggcttggcctaacccg

SEQ ID NO: 175994 - DNA, 629 bp, Homo sapiens
  misc_feature: GYAE6OF01DF9P9.51.1.A01.1.454.CMB.1.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
tcagcgatcgtatacacgaccggtgctcgatttagacgtctcatcaggggagtcccaaccaggacacagcatggacatgagggtccctgctcagctcctggggctcctgctgctctgtctctcaggtgccagatgtatcatccagatgacccagtctccatcctccctgtctgcatctataggagacagaatcacatcacttggccgggngagtcaggactattagcatgtatctagtaattggtatcaagaaccaaaaaccgagggaaacnccctaagcctcctgactcctcgatcgactaactaccgtaagtttacggaaaccgtcggggtaccctagtacgtaaggttcagtacgacgtaaggttcggcgtcggtagggacctagttactttacctaccttttaccacctactaccagtacgagtaccgttgaccgtacgtaccgtaaggtaaagtattaacgttacgaactaaactaatttactttaacggttactaaccaagttaacgttatagtaaacttaccttccgtacccgtaccttacgttaccggttacggacgggtaacgggacgtaagggtcgggaacttaacgaaacggtacgtggtagaccgtgtccgtaaccg

SEQ ID NO: 175995 - DNA, 590 bp, Homo sapiens
  misc_feature: GYAE6OF01BE7MK.51.1.A01.1.454.CMB.1.raw
  modified_base (283)..(283): a, c, t, g, unknown or other
  misc_feature (283)..(283): n is a, c, g, or t
  modified_base (485)..(485): a, c, t, g, unknown or other
  misc_feature (485)..(485): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttggccggcgagtcaggacattagcatgtatctgaattggtatcagacaaaaccgaggaaacgccctaagctcctagactccncgatgacatcctaagtttggaaacgtgggtacccatacgaaggttcagtcgacaaggttggactcggtaggactaggtatttcgtactttcacctatcagcagactagcagtccgtagaaacgtattattacgaactaaactattaacttaacttagtaactaaacgtagttaactacgtaaacttaactcccttacccgtnttaccggtaccgggttttaccgggggaccggggggtacctaaagggggttcggaaacggtactaaccggtaaaggtcggtaacgttggtacggtcgtacgacccg

SEQ ID NO: 175996 - DNA, 556 bp, Homo sapiens
  misc_feature: GYAE6OF01B2VP1.51.1.A01.1.454.CMB.1.raw
tcagcgatcgtatacacgaccggtgctcgatttagacgtctcatcagggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattagcatgtatctgaattggtatcagacaaaaaccgagggaaacgccccaagctcctgactcctgatgcatccaatttggaaacaggggtccatcaaggttcagtgactaaggtgctcgtgggacagtactttcactttcactatcagcagactgacagtcctagaacgtatattcgactaactattattactagtactaacgtagttaatgtaaattaactcctacccggtcttaccgttaaccgtttcggggacgggaacggggtaaccgtaaggggtcggggtaactaacgaaaaccgggtactacgggtaggccctggtacctaacccg

SEQ ID NO: 175997 - DNA, 545 bp, Homo sapiens
  misc_feature: GYAE6OF01BKSWP.51.1.A01.1.454.CMB.1.raw
  modified_base (185)..(185): a, c, t, g, unknown or other
  misc_feature (185)..(185): n is a, c, g, or t
  modified_base (264)..(264): a, c, t, g, unknown or other
  misc_feature (264)..(264): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacttgccgggcagtcaggacattagcatgtatctgaattggtatcagacaaaaccgagggaaacncccctaagcctcctgactcctgatgcataccaagtttcggaaacgtgggtacccatacgaaggttcagtgacgaaggtgctcgtagggactagtactttcactttcacctatcagcagtactgacagcctagaagtatacttagactaaactattaacttactacgtactaaatagttatacgtaattaactcccttacccgcttacgtaccgtttcgggacgggtacggtaccgtaagggtcgggaactaaccgaaacgtagtcggtacgctcgctaacg

SEQ ID NO: 175998 - DNA, 723 bp, Homo sapiens
  misc_feature: GYAE6OF01EEHBL.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtcctccatcctccctgtctgcatctataggagacagaatcaccatcacttgccgggcgagtcaggacattagcatgtatctgtaattggtatcaagaacaaaaccgagggaaacgacccctaagcctcctgactcctcgatgactactacctaagtttacggaaaccgtacggggtacccagtacgtaacggttcgaaggtgacgtaaggtcggtctacggtagggaactagttactttacctaacctttacaacctacgttacacgtactaacggtacctcgggacctaacggtacccttagaaacggttaattaacgtttaccggaactaaaacccttaattaaccgtttaaacgtcggttaaacctaaaccgtaaggtttaaagttacttaaacgttaacccggtttaccctacccgttacccgttaaccgttaacccgggttttaccgggaacccggggggtaacgggtaaacccgggttaacgggggttacggggaaaccgttaaccggtaaaacggtaaaccggttcgggtacgggtaaccggttcggtaacctaaacccggg

SEQ ID NO: 175999 - DNA, 582 bp, Homo sapiens
  misc_feature: GYAE6OF01B4FAW.51.1.A01.1.454.CMB.1.raw
  modified_base (362)..(362): a, c, t, g, unknown or other
  misc_feature (362)..(362): n is a, c, g, or t
tcagcgatcgtatacacgaccggtgctcgatttagacgtctcatcagggggagtcccaaccaggacacagcatggacatgagggtccctgctccagctcctggggctcctgcctgctctggctcgtcaggtcgccagatgtatcatccagatgacccagtctccatcctcctgtctgcatctataggagacagaatcgaccatcacgttggccgggcagtcaggacattagcatgtatctgaattggtatcaagactaaaaccgaggaaacgccctaagcgtccgtgactcctcgatgactatccaagtttggaaacgtacggggtaccagtacgaaggttacagtgacgtagtcggctcgngggactagtactttcaactttcaacctagtacacgcacgtactgcagtccgtaggaactacgtctacgacaactacttaagttacgtacgtacaaacgtagttaatagtaataactccgtaccgtcttaccgtaccgtttcgggacgggtacgggtaacgtacggggtacggaactacggaaacgggtaacgttcggtaacggtcgtgtcccgtaaccgg

SEQ ID NO: 176000 - DNA, 577 bp, Homo sapiens
  misc_feature: GYAE6OF01DUCNO.51.1.A01.1.454.CMB.1.raw
  modified_base (185)..(185): a, c, t, g, unknown or other
  misc_feature (185)..(185): n is a, c, g, or t
  modified_base (211)..(211): a, c, t, g, unknown or other
  misc_feature (211)..(211): n is a, c, g, or t
  modified_base (307)..(307): a, c, t, g, unknown or other
  misc_feature (307)..(307): n is a, c, g, or t
  modified_base (445)..(445): a, c, t, g, unknown or other
  misc_feature (445)..(445): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacttggccgggnagtcaggacattagcatgtatctagaattggtatcagacaaaaacagggaaacgccctaagctcctagatcctcgatgcatacaaagttcgaaacngggtacccatcaaggttcaagtgacaaggtggctacgtgggacagtatttacactttcaacctatcaagcaacgactggactaagtcctagaagattactgaccaaactattaattactagtactaaacaaggttaanagtaattaacgtccctaccggtaccttaccgtacgtttcggggacgggtaaacgggtaaccgggtaaagggtcggggaaaccttacgaaaaaccggtaccgttacggtacggtccgtagtaccgtaaacccg

SEQ ID NO: 176001 - DNA, 637 bp, Homo sapiens
  misc_feature: GYAE6OF01BW8G5.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatcgtagaattggtatacaagaacaaaaaccgagggaaacgacccctaagccttcctagactcctcgatcgactactacctaaagtttacggaaaccgtacggggtacccaagtacgtaaggttcaggtagacgtaaggtcggtactacggtggggaactaggttactttacctacgtttccaacctacgtcaacgacgaacgtacgtcgacacgtaccgtagtaagtattacgtagactaaactactttaattacgtacgtaacctaaacgtagttaagttagaacgttacgtccctacccgtcgttaccgtaccgggttacggggaccgggggtaaccgtaaggggacggtaaacgtacggtaaccgaacggtaccgtaacggttaggtcggtcgtccgtaaccg

SEQ ID NO: 176002 - DNA, 586 bp, Homo sapiens
  misc_feature: GYAE6OF01A5RNE.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctagaattggtatcagaacaaaaaccgagggaaacgcccctaagcctacctgactccgtacgatgctactacctaaagtttacgggaaaacgtcggggtacccagtaccgtaaggttcgagtgacaaggtcggactgtacgggactagtactttcgactttcaacctatcaagcagactcgacacgtctagtaacgtatacttacgactaaactattaattaactagtactaacgtagttatagtaactaactccgtcccgtctaccgtacggttccgggacgggaacggtaccggtaaggggtgggaaacttaccgaaaacggtacgttagggtacggacttcggcctaaccg

SEQ ID NO: 176003 - DNA, 584 bp, Homo sapiens
  misc_feature: GYAE6OF01BWKS8.51.1.A01.1.454.CMB.1.raw
  modified_base (262)..(262): a, c, t, g, unknown or other
  misc_feature (262)..(262): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattagcatgtatctgaattggtatcagacaaaaccagggaaanccccgtaaagcctctgatcctgatgcatcctaatttcggaaacaggggtacccatacgaaggttcagtgcaagtggactcgtgggactaggtatttactacgttttaccaccgtatcgacgacagactggaccagtcctagaagtattaagttagactaactaacttatttacgtcgttacaaactagttattagtataacttccgtacccgtcgttacctacgttttacccgggacgggtacggggaacccgtaaggggttcggggaacttaaccgaaaccggtaaacggttcggtacggtccgttcggaccgtaaacccg

SEQ ID NO: 176004 - DNA, 726 bp, Homo sapiens
  misc_feature: GYAE6OF01D7UXM.51.1.A01.1.454.CMB.1.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatccctccctgtctgcatctataggagacagaactcacatcacgtgccggngagtcgaggacattagcatgtatcgtagtaattggtatcaagaacaaaaaccgaggaaacncccctaagcctacgtgactccgtagatgactaactaccgtaaagtttacggaaaacggtcgggtacccaatacgtaaggttcaggtacgacgtaaggtcggctcggtagggactagttactttccgtacttttaccaacctattaccgacgacgacgtactcgacgacgtaccgtaggtaaagtacgttaacgttacgaacctaaacttaacgttttaactttaacgtaccgttaaacctaaacggttaagttaacgttaacgttaaacttaacccgttaccccgtttacccccggttacgtttacccgttaacccggggtttaccgggggaacccggggtaaaaccgggggtaaccgggttaaacggggggttacggggttaaaccgtaaacccggttaaaaaccgggttacggttacgggttaccggtacccggtaccgtacccgtaaccccg

SEQ ID NO: 176005 - DNA, 659 bp, Homo sapiens
  misc_feature: GYAE6OF01DIBNF.51.1.A01.1.454.CMB.1.raw
  modified_base (176)..(176): a, c, t, g, unknown or other
  misc_feature (176)..(176): n is a, c, g, or t
  modified_base (257)..(257): a, c, t, g, unknown or other
  misc_feature (257)..(257): n is a, c, g, or t
  modified_base (385)..(385): a, c, t, g, unknown or other
  misc_feature (385)..(385): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccagtctccatcctccctgtctgcntctataggagacagaactcaacctatccacttcgggccggcgagtcgaaggactagttagcatgtatcgtagtagttgtanacgaacgaacaaaaacgaggaaccgccctaagcctcgtactactccgtacgatcgtacatacgtaacgttacggaaacgtcgggtaccaagtacgttaaggttcaggtcgagtaaggtcgtactcggngggtaactagttactttccgtactttaccgaacctaacgtcgaacgtacgaacgtacgttacgaccgtaaccgtaccgtagtaacgttaacgtaccttacggaacctaaaccgttaacgttaactttaaccggtaacttaaccgaaacgtttagttaaccgttagtaacctttaactccgttaacccgtccttacgtaccgggttaccgggacgggaacgggtaccgtaggggtacgtaacgtaacgaacgtacgtaggcacgtctaccgtacg

SEQ ID NO: 176006 - DNA, 711 bp, Homo sapiens
  misc_feature: GYAE6OF01AXJE7.51.1.A01.1.454.CMB.1.raw
  modified_base (266)..(266): a, c, t, g, unknown or other
  misc_feature (266)..(266): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccgggcagtcaggacattagcatgtatctgaattggtatcagacaaaaaccgagggaaacncccctaagcctcctgactccgtcgatcgactacttacctaaagttttacgggaaaaccgtacgggggtaccccaagttaccgtaaagggttccaaggttcgacgtaaggtcgggtcttacggtaggggaacctaaggtattttaccgaccttttccaacccgtattacgacgaccagaacctcggactacgtcccgtaggaaagtacttacgtttacgaacctaaactaatttaactttaacttcggttaacctaaacgtaacggtttaaagtacgtaaactttaacctacccgttcccccggtacttacccgtttaaacccggtttcccggggaaccggggtaaccgggggtaaccccggtaaagggggttacgggggtaaaccttaaccggaaaacgggtaaccttaggggttaccgggtccgttcggaacccgttaacccgg

SEQ ID NO: 176007 - DNA, 613 bp, Homo sapiens
  misc_feature: GYAE6OF01A57AT.51.1.A01.1.454.CMB.1.raw
  modified_base (507)..(507): a, c, t, g, unknown or other
  misc_feature (507)..(507): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatccctcctgtctgcatctataggagacagaatcaccatcacgttggccgggcgagtcgaggacattagcatgtatctgaattgtatcaagaacaaaaccgagggaacgcccctaagcctcctagactcctcgatcgactactaccgtaaagtttacgggaaaaccgtacggggtacccagtaacgtaacggttcgaagtgacgtaaggtcggtccgtacgttagggactagtactttctacctttacacctatcagacacgacgtgacgtacgcctaaggaagtacttagttacgacctaaacttagttaactttaaccgtagttaaccaaacgtagttaacgttanaacctttaactcccgtaccgtacttccgtaacggttcgggaaccgggtacgggaaccgtaaggggtcggaagtaacgaaacggtacgtggtacgctgcccgtaacg

SEQ ID NO: 176008 - DNA, 726 bp, Homo sapiens
  misc_feature: GYAE6OF01BOE5K.51.1.A01.1.454.CMB.1.raw
  modified_base (218)..(218): a, c, t, g, unknown or other
  misc_feature (218)..(218): n is a, c, g, or t
  modified_base (595)..(595): a, c, t, g, unknown or other
  misc_feature (595)..(595): n is a, c, g, or t
tcagcgatcgtatacacgaccggtgctcgatttagacgtctcatcagggggagtcccaaccaggacacagcatggacatgagggtccctgctcagctcctggggctcctgctgctctggctctcaggtgccagatgtatcatccagactgacccagtcctccatccctccctgtctgctatctataggagacagatcaccatctacgttcggccgggngagtcgaaggactattagctattgtatcgtagtaattggtatcgaagaaccgaaaaaaccgaggggaaaaccgtacccctaaggccttacccgttagaaccttcccgtacggactcggacctacttaaccgtaaacgtttacgggaaaaccgtcggggtaaccagttaaacgtaaggtaccgtaaggtacgtacgtaaacggtcggtacttccgggtaggggtaacctagtttacgtttacctacttttaaccaaccgttaacgtaccacgtaacccgaagtacccgtcggaactacggtaaccgtagaaagttaacgttactacgtaaacctaacgttaattaacgttaaccgtagtaaaccgtaagtacgttaanacggttaaacttacctccgtacccttacgtaaccgtttaccgggttaccgggacgggtacgggtaaccgggtaagggtcgggaaacctaacgtaaaccgaacggttgacccggtctacccgcgttaaaccg

SEQ ID NO: 176009 - DNA, 721 bp, Homo sapiens
  misc_feature: GYAE6OF01DOWLV.51.1.A01.1.454.CMB.1.raw
  modified_base (186)..(186): a, c, t, g, unknown or other
  misc_feature (186)..(186): n is a, c, g, or t
  modified_base (214)..(214): a, c, t, g, unknown or other
  misc_feature (214)..(214): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccagtctccatcctccctgtctgcatctatagganacagaatcaccatccacgttggccgggngagtcgaggactattagctatgtatcgtagtaagttggtatacgaagaaaccgaaaaaaccgaacgggaaaccggtaccccgtaaaggccttaccgtcgtaacttcccgtacgtactcggacctaacttaaccgttaaagtttaacgggaaaaccggtacggggttacccaacgttaccgtaaacggtttacgaacggttacggaccgttaaagggttcgggtaccgtacggtacggggtaaccttaaggttacttttacctaacctttaccaaccgtagtaccgaagtacgtaacggacttcggaccgtaacgacccggttaaggaaagtagtttaacgtacgtaaaccgtaaacttatttaacgtttaccgtaacggtaacctaaacgtaggttaactagtaaccgtttaactcccgttacctaccgttaccgtacgggttaccgggacgggtaacgggtacggtaaggggtacggactaacgaacgtagtcgagctcgactacg

SEQ ID NO: 176010 - DNA, 592 bp, Homo sapiens
  misc_feature: GYAE6OF01AQT5U.51.1.A01.1.454.CMB.1.raw
  modified_base (269)..(269): a, c, t, g, unknown or other
  misc_feature (269)..(269): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtcctccatcctccctgtctgcatctataggagacagaatcaccatcacttgccgggcgagtcaggacattagcatgtatctagaattggtatcaagaacaaaaccgagggaaacnccctaagcctcctgactcctcgatcgctactaccgtaagtttacggaaacggtacggggtaccctaagtacgtaaggttcaggtcgacgtaaggtcggactcggtacgggactaggtactttcctaccgtttaccaaccgtataccgagccgtaacgacctgaccgtacgtaccgtagaagtacgttataccgaactaactattaacttacgtatacaacgtagtatacgtactacctccgtaccgtcttaccgtcggttacgggacgggtacggacgtaggggtacgaacgtaacgaacgtgtacggacgtacgtgcctacg

SEQ ID NO: 176011 - DNA, 659 bp, Homo sapiens
  misc_feature: GYAE6OF01EYI3L.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcacatcacttcgccgggcgagtcaggacattagcatgtatctagtaattggtatacaacgaacaaaaaccgagggaaaccgacccctaagcctccgtagtactcctacgatcgactataccgtaagtttacggaaacgtacgggtaccctagtacgtaaggttacaggtagacgtaaggtcgtcgtcgtagggactagtactttactactttacaactactaccgagtacaagtacgacgactacgtaccgtagaacgtattacgtacgaacctaacgttaactttaaccttacgttactaaccgtaaacgtagttaattacgttaacttaaccttcccgttaccccacgtttacccgttaccggtttaccggggaacggggtaaccgggtaaccgggttaacggggtagggttaaacctaaccggaaaccggttacgtacgggtagtccgttcgaccgttaacccg

SEQ ID NO: 176012 - DNA, 577 bp, Homo sapiens
  misc_feature: GYAE6OF01D357S.51.1.A01.1.454.CMB.1.raw
  modified_base (566)..(566): a, c, t, g, unknown or other
  misc_feature (566)..(566): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagatcacatcacttgccggcgagtcaggacattagctatgtatctagtaattggtatcgaagaacaaaaaccgaggaacgacccctaagcctctgtactcctcatgctatacctaagtttacggaaacgacggggtaccatacgtaaggttacagtacgacgaagtggctacggacggacgtagtactttctacttttaccaacctagtacagcaagctacgacagtccgtagaagtattattacgaacaactattaattacgtacgtaaccaagagtatagtactaactccttaccgtacttccgtacgttacgggacgggtaacgggtaaccagggggtcggaacttaacggaaaaccggtacgtacggtaggcccngtcctaacccg

SEQ ID NO: 176013 - DNA, 766 bp, Homo sapiens
  misc_feature: GYAE6OF01AW4NT.51.1.A01.1.454.CMB.1.raw
tcagcgatcgtatacacgaccggtgctcgatttagacgtctcatcaggggagtcccaaccaggacacagcatggacatgagggtccctgctcagctcctgggctcctgctgctctggctctcaggtgccagatgtatcatccagatcgacccagtctccacttcccgtccctgtcctgcctatctaagtaggagacagaatccaacatcgacgttcggccggcgtacgtacgacggactaagttacgactaagttgtacgttacgtagtaagtttcggtactaccgaacgaaaccgaaaaaccggaacggggtaaaaccctaccccgttaaacgtccgttaaccgttacgtaaccttcccgtaacgtagtccgactaaccgttaacccttaaaggtttaccggtaaaaccggtaccgggttacccgtaacgttaacggttaacggttccgacggtacggtaacgtaacggtcggtccgtacgtacgggaacttacgttactttacgtctttaacccacgtacgtacgtacaccggatacgcgacgtaacgacgtagtacgtagtattacggactaaacgttctaactttcgtactaaacaacgttaataccggttaatacttaccgtccccgttaccgtacccgtttagttacccgggttaccgggaagggtacccgggttaagtaccgggggtaacgttaacgttaaaacccggaacggttaccgggttagtacccgggtaacttacccggaccccgttaaaccg

SEQ ID NO: 176014 - DNA, 729 bp, Homo sapiens
  misc_feature: GYAE6OF01BJYP0.51.1.A01.1.454.CMB.1.raw
  modified_base (539)..(539): a, c, t, g, unknown or other
  misc_feature (539)..(539): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtcgccagatgtatcatccagactcgacccagtcctccatccctcctgtctgctatctagtaggacgactagaactccacctagtccacgttcgggccggtacgtagtcgaggactagttagctagttagtactcgtagtaagttggtaactacgaacgaaaccaaaaccggaacggaaccgtacccctaagtcctctgtacctccgtactagtcgactacgtaccgttaaggttacggaacgtccgggtacctagttacgtaacgttgacggtacgacgtaacggtcgcgttacggggtacgaacgttacgttactttcgtaacctttcaaccgtacctacgacgtacgaacgttccgtagaccggtacgaccgttaggaacgttacgttagtaaccgtaactaaaccgtttnttaaccttagtaacgttaacctaaacgttacgtaagtaacgtttaacaacccgtttaccgtacccgttagttaccccgtaccgggtttaccgggaaacggggtacccggtaacgggggtaacggttacgggaaaccgttaccgtaaaaccgggttcggtaacgggtccacggttaccgtccggtaaaccc

SEQ ID NO: 176015 - DNA, 618 bp, Homo sapiens
  misc_feature: GYAE6OF01ADXVW.51.1.A01.1.454.CMB.1.raw
  modified_base (213)..(213): a, c, t, g, unknown or other
  misc_feature (213)..(213): n is a, c, g, or t
  modified_base (272)..(272): a, c, t, g, unknown or other
  misc_feature (272)..(272): n is a, c, g, or t
  modified_base (411)..(411): a, c, t, g, unknown or other
  misc_feature (411)..(411): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttcggccgggnagtcaaggacagttagcatgtatctagtaattggtatcagacaaaaaccgagggaaacncccctaagcctccagactctcggatgctaacgtacctaaagtttacggaaacgacggggtacccaagtacgtaaggttccaggttcgactaaggtcggcctaggtacgggaactagtacttttacgactttacacctanccaagtcagactgacacgcctaggaatatactgaacaagtattaatttacgagtaaccaagtagttatacgtaattaaccgtccctacccgtcgttaccgttaccgggtttcccggggacgggaaacggggtacccgtaaggggtacgggaaacctaacgggtaaaaccgtaacggttggaacccgtgtaaccgtacccgtaacccg

SEQ ID NO: 176016 - DNA, 710 bp, Homo sapiens
  misc_feature: GYAE6OF01BHEBI.51.1.A01.1.454.CMB.1.raw
  modified_base (123)..(123): a, c, t, g, unknown or other
  misc_feature (123)..(123): n is a, c, g, or t
  modified_base (130)..(130): a, c, t, g, unknown or other
  misc_feature (130)..(130): n is a, c, g, or t
  modified_base (701)..(701): a, c, t, g, unknown or other
  misc_feature (701)..(701): n is a, c, g, or t
tcagcgatcgtatacacgaccggtgctcgatttagacgtctcatcagggggagtcccaaccaggacacagcatggacatgagggtccctgctcagctccgtggggctcctgctgctctggctntcaggtnccagatgtatcactccagactcgacccagtcctccactccctcctgtctgctatctagtacggagacaagaactaccacctatccgtaccgttcgggccgggacgtacgtacgaggtactagttacgctagtgtactagtagttagttaggtactacgaacgaaccgtaaaacggaacgggtaaccctaccccgtaagtcccgtaccgtacgtaccgttcccgtacgtacgtaccgaaccttacgttaacccggttaaagggttaaccgggaaaccgggtaccgggttaccctaacggtaacggttaacggttacagggtacgtacggtacgggtcgtaccggttcggtaacgggtacttacggtttaccttacgttaccgttaccacgtacgtacgagaccgtacgtacgacaccgtacgtaccgtagaacgttatactaacgattaaactgttactacgtactaactacgtattagaaccgttactcccctcgtacccgtatccgggtaccgtcggggaaccggtagggtaccggtagggagtaacctaacgacgttcgggagcgtacncggtctacg

SEQ ID NO: 176017 - DNA, 729 bp, Homo sapiens
  misc_feature: GYAE6OF01DBJV4.51.1.A01.1.454.CMB.1.raw
  modified_base (406)..(406): a, c, t, g, unknown or other
  misc_feature (406)..(406): n is a, c, g, or t
tcagcgatcgtatacacgaccggtgctcgatttagacgtctcatcaggggagtcccaaaccaggacacagcatggacatgagggtccctgctcagctcctggggctcctgctgctctggctctcaggtgccagatgtatcatccagatcgacccagtctccatcctccctgtctgcatctagaggagacagaactccaccattccgacgttcggaccgggagacgtacgaggaactattaggctaagttgtatcgtagtaattaggtatacaacgaaacaaaaacgaggaaccacccgtaagtcctacgtagtactccgtacgatcgactaactaccgtaaagttacggaaacgtccgggtactaacgtacgtaaggtctagtcgtacgaaggtcgacgttacggnggtaactacgttaactttaccgtactttccaaaccttgtaccgtaagaccgtaacgtacgtcgaacgttaccgaccgttaagtaacgtaacttagtaacgtaaccttaaactaagttaaccgtttaacgtaacgtaaccgttaaaacgttaacgttagtaaacgttaaaccttaaccgttccctaacccggttccccttaacggttacccgggtttacggggaaaccgggtaaccgggaaaccgggttaaggggttaccggaaaaccgttaaccggaaaacggttacgttacgggtacggtacccgtcgtaaccgtaacccgg

SEQ ID NO: 176018 - DNA, 746 bp, Homo sapiens
  misc_feature: GYAE6OF01EMEYW.51.1.A01.1.454.CMB.1.raw
  modified_base (190)..(190): a, c, t, g, unknown or other
  misc_feature (190)..(190): n is a, c, g, or t
  modified_base (648)..(648): a, c, t, g, unknown or other
  misc_feature (648)..(648): n is a, c, g, or t
  modified_base (709)..(709): a, c, t, g, unknown or other
  misc_feature (709)..(709): n is a, c, g, or t
  modified_base (738)..(738): a, c, t, g, unknown or other
  misc_feature (738)..(738): n is a, c, g, or t
tcagcgatcgtatacacgaccggtgctcgatttagacgtctcatcaggggagtcccaaccaggacacagcatggacatgagggtccctgctcagctccgtggggctcctgctgctctggctctcgaggtcgccagtatgtatcactccgagactaccgaccctagtcctcctacttcccctcctgttctnctattacgtaagtaggaacgacaacgtaactacctaacctactaccgtaccggttccggggacccgggacgtaacggtaccgaacggtactaaacgttacgattagttacgttacttagtaaggttaaggttacggtaactaacggaaaacggaaaaccgaaaaacccgggtaacggtaaacccccgttacccgtaccgtccgttaaccgtcgttaccctacgtcgtaacgtacctaactaaccgttaacgttaaacgggttaaccggaaccgggtaccgggttaacctagttaacggtaagtacgagtaccgagtacggtcgtacggtagacggtactattacctttactacctacatactcgacgtcgaagtcagtactagacgtaatacgtagtactacgaacttaagttacttagttacgtacgtaactaagttagtacttacgtaccttaccncccgtacgttccgtaaccggttcggggaaccggtacgggaaacgggttagggacggttaanacccgtaaagtaccgtggtacgagttccngtacctag

SEQ ID NO: 176019 - DNA, 763 bp, Homo sapiens
  misc_feature: GYAE6OF01DFVJ0.51.1.A01.1.454.CMB.1.raw
  modified_base (154)..(154): a, c, t, g, unknown or other
  misc_feature (154)..(154): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccngtcctccatccctccctgtctgctatctagtaggagacagaatccaacctatcacgttcggccgggacgagtacgaggactattacgctatgtactcgtagtaagttggtatacaagaaccgaaaaacgacgggaaccgcccgtaagcctacgtcgtactcctagactacgactaacttaaccgtaaaggttaccggaaaaccggtacgggtacccaacgttacgtaacggttacgtaggtcgtaaccggtaacggtcggtacgttacgggtacgggtaactaacggtttaaccttttcccgtaaccttttacccgaaccgttacgtaccgtaacggtaccgaacgggttacccctcggtaaccgaacgggttacccgtaagggtaaacgtttaacgttaccgtaacggtaaccttaagttaactttaaccgttacgtaacgtaaccgtaaagtagttaactacgttaaacttaacttccccggtaccttaccggtaccgttaccgggtacggggaaccgggtaacggggtaaacccggtaggggtaacccgggtaaactaaccggtaaacggttcggttaacggtccggaccctgtaacccgtacccg

SEQ ID NO: 176020 - DNA, 774 bp, Homo sapiens
  misc_feature: GYAE6OF01BGV3X.51.1.A01.1.454.CMB.1.raw
  modified_base (130)..(130): a, c, t, g, unknown or other
  misc_feature (130)..(130): n is a, c, g, or t
  modified_base (192)..(192): a, c, t, g, unknown or other
  misc_feature (192)..(192): n is a, c, g, or t
tcagcgatcgtatacacgaccggtgctcgatttagacgtctcatcaggggagtcccaaccaggacacagcatggacatgagggtccctgctcagctccgtggggctcctgctgctctggctctcaggtcnccagatgtatcatccagatcgaccagtcctaccactccctccctgtctgcattctagagganacagaactcacatcgtacgttcgggccgggacgtacgtacgaaggtactagttacgactagttaggttacttacgtaggtaagtttaggtaactacggaacaaaccgtaaaaccggacgggaaacctaccccgtaagtcctacgtacgaccttccgagtatcgactacgtacttaacggttaaccggaacgtaccgggtacccaagttaccggtaaaggttcaggtacgacggtaaggtcggtaccgtggtaacgggtattacgtttactttaccgtaccttacaacgtctacgtacacggtactacgtacgactaccgtacgtaacgtaagtaccgttaagtaaccgtaaccgttaaagttactttaaaccgttacgtaaaccggtaaccgttaaacggttaagttaacttaacggtttaacctaacccggtttcccgtacccgttacggttaccgggttacccgggttaaagggggaacccggggtaaacggggtaaccgggtaacggggtaacggtaaccgttaaaaccggtacgggttaacggttaccgggtcggttaacccaacggttctaacccgg

SEQ ID NO: 176021 - DNA, 776 bp, Homo sapiens
  misc_feature: GYAE6OF01DTWGN.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctagtaggagacagaatcaccatcacttgccgggctagcaggactattagctatgtatcgtagtaagttggtaactcgaagaaccaaaaaccgaagggaaacgacccctaagcctacgtcgtactcctcgactgacattacctaagtttacgaaacgacgggtaccagtacgtaacggttcaagtacgacgtaaggtcggacttcggtaggactaggttaacttttaccgtacctttttacccgaacccttaacgtacccgtaacggtaccgtaacggttaacccgtacgtaacccggtaaccggtacccgttaaacggtaaaggttaacgtttaaccgtttaacggaacccttaaaccgtttaaacttttaaacgttttaaccgtttaacgttaacccgtaaaacccgtttaagggttaaacttaacggttaaacgtttaaacccttcccggttaaccccccgttaccgttacccggtttaaacccggttttcccggggaaacccggggttaaccggggtaacccgggtaaagggggttacgggtaacgtaaccgtaaaaccgtacgtacgggttacggtaccgtacggtcctaacccg

SEQ ID NO: 176022 - DNA, 909 bp, Homo sapiens
  misc_feature: GYAE6OF01BGW38.51.1.A01.1.454.CMB.1.raw
  modified_base (219)..(219): a, c, t, g, unknown or other
  misc_feature (219)..(219): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtcctccatccctccctgtctgcattctagtaggagacagtaactcacctatcacttcggccgggngagtcaggactattagctatgtactcgttagtaattggtactacaaacgtaacaaaaaaccggacggggaaaaccgtccccgtaaaggtccttaccgtacgtaccttccgtacgtacgtcgacctacgttacctaaaggtttacggaaaccggtacggggtacccagtacgtaacggttcaggtcacgtaacggtcggtacgtcgtacggggaactacggtattttacctacttttaccgaacctacgttacgagtaccgtaagtacggttcgaccgtacggtacccttaagggtaaacgttacgtttaacttaacgggtaacctaaacgtttaaacgtttaaccgtttttaacgtaacccggtttaaacggtaaaacccggttttaaagggtttaaccgtttaaacgggttaaaacccgttttaacccggttaaccccccggttttaccccggttaacccgttttaaccccggggttttaaccccgggttttaaaaccccggggggggttaaaccccgggggttaacccggggggggttaaaaccccggtttaaacgggggggggtaaaccggggggtttaaaacccgggtaaaacccccgggttaaaaaccggggtttaaacccgggtttaggggtaaaccccggggggtccgttttaaacccggaaaccccgggttttaaaccccgg

SEQ ID NO: 176023 - DNA, 785 bp, Homo sapiens
  misc_feature: GYAE6OF01BYZT2.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcgaggtgccagatgtatcatccagatgacccagtctccatccctccctgtctgctagtctataggagacagaatccaaccatcctacgttcggccgggacgagtcgaggtactagttacgactattgtacttacgtaggttaagtttaggtaataccgtaacgaaaccgtaaaaaaccggaacggggtaaaccgtaacccccgttaagacccgtttacccgtacggtaccttcccgtacggtaacgttccggaccctaactttacccgttaaacgttttaacgggaaaaccggtaccggggttaccctaagttaccggtaaaccgggttactacgggtaacggtacggtaaggtacggtcgttacggtacgggaacttagtactttaccgtactttacaaccgtgtacctacgactacgtacgtacgacgtacgtaccgtagtaacgtattacgtacgtaactaattattaactttacgacgttaacctaagttaaggttacgtaacgttaactaccgttacccgtcccgttaccgttacgttacccggttaccggggtaacgggtacggggtaacccggtaaacggggtaccgggtaacgtaaacccggttaaacggtaaccggtttacgggtacgtaccgttacggaaacccgttaacccg

SEQ ID NO: 176024 - DNA, 642 bp, Homo sapiens
  misc_feature: GYAE6OF01AQUAE.51.1.A01.1.454.CMB.1.raw
  modified_base (269)..(269): a, c, t, g, unknown or other
  misc_feature (269)..(269): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccgggcgagtcgaggactattagcatgtatctgaattggtatcagacaaaaccgagggtaaacnccctaagctccgtagacttccctcgactcgactactacctaaagtttacgggaaaaccgtacggggtacccctagttaccgtaaaggttccgaaggttcgaaccgtaaggtcggtctacggtacgggacgtaacggtactttactaaccttttaccgaacctacgttacgaacgtacgaaggtacctaggaccgtaaggtaccctaaggtaaagtacttaacgtttacggaacctaacgtaattaactttacgtagtaaccaacgtagttatacgaaattaacgtccctacccgtcgtacgttaccggttcgggaacggtacggtacggaaggggtggaacgtacgaacgtacgtaggtacgcgtgcctaacg

SEQ ID NO: 176025 - DNA, 681 bp, Homo sapiens
  misc_feature: GYAE6OF01ARQQP.51.1.A01.1.454.CMB.1.raw
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
tcagcgatcgtatacacgaccggtgctcgatttagacgtctcatcagggggagtcccaaccaggacacagcatggacatgagggtccctgctcagctcctggggctcctgctgctctggctctcaggtgccagatgtatcgatccagatgacccagtctccatcctccctgtctgcatctataggagacagaatcacatcacttgccgggngagtcagggacattagcatgtatctgaattggtatcaagacaaaaccgngggaaaccnccctaagctacctgacttcctgatcgactataccctaagtttacggaaacgtacggggtccagtaccgtaaggtcctaaggtcgtaacgaaggttcggcttaccgggtacgggactaaggtcttttacctaaccgttttaccaacctataccgacgtacgtaacggtacgttacgactacgtaccccgtagtaaacgtacttaacgttacgaacctaaactaacgtttacgttaacgttacgtaaccctaagttaaccgttagtacgtaacgttaacctccgtaacccgtctaccgttaccggtttacgggacccgggtaacgggtaacccgggaaggggttccgggaaaccttaaaccgggtaaacccggtaaacgtttacgggacggttacgcccggtacctaaacccgg

SEQ ID NO: 176026 - DNA, 764 bp, Homo sapiens
  misc_feature: GYAE6OF01CUU4M.51.1.A01.1.454.CMB.1.raw
tcagcgatcgtatacacgaccggtgctcgatttagacgtctcatcaggggagtcccaaccaggacacagcatggacatgagggtccctgctcagctccgtggggctcctgctgctctggctctcaggtgccagatgtatcatccagatcgacccagtcctccatccctccctgtctgccatactagtaggacacagaactccaacctatcctacgtcggccgggcgagtcgaaggactaagttacgacattagtaactcgtagtaagtttcggtaatacacgtaaaccaaaaaccggacggggaaaccaccccgtaagtacctccgtacgtacttccccgtagacgtacgacctaacttaacccgtaaaggtttacgggaaaaccggtaccgggtaccctaagttaccggtaaacggtaccgtagacgaaccgtaaaggtcgggtcctacgggtagggtaacgtaacgtttactttccgttaacctttacaacctactccgtagtaccgaacgtaccgtcgaaccgtaccgacttaaggaataacgttagtacaaccctaagtactttaaccttacgtaacgtaacctaacggtttaagtacgttaataacccgttaaccttccggtaaccccccttacggttacccgttaccggggtttacccggggaacggggttaaacccggaaccgggttaagggggtacgggtaaaccctaacggaaacggttaccggttacggacggtactaccgggacccttaacgg

SEQ ID NO: 176027 - DNA, 778 bp, Homo sapiens
  misc_feature: GYAE6OF01BNSHI.51.1.A01.1.454.CMB.1.raw
  modified_base (620)..(620): a, c, t, g, unknown or other
  misc_feature (620)..(620): n is a, c, g, or t
tcagcgatcgtatacacgaccggtgctcgatttagacgtctcatcaggggagtcccaaccaggacacagcatggacatgagggtccctgctcagctccgtggggctcctgctgctcgtggcctctcgtagggtcgaccagatgtatcactccgagactcgaccctagtcctccacttccctccgttgtacctgactacgtacctaagtaggaacgacaactactacgacctacttccgtaccgttcgggcccgggacgtaacggtcgaaggtactagtacgagtgttacgtaactcgttaagtaacgttggtaactaccggaaacgaaaacccgtaaaaccggaacggtaaacccctacccgtaatccgtttacgacggttcctaccggttacgacttacgacctacgttaaccgtttaaagtaacccgggtaaccggtcggtaaccctaggtttaaccgtaagggtacctacgggtaacggtagttaaccgggtcggttaccgtacggggtacgggttaacttacgtttacttacccgtaacgttcctaacgtctacgacgtacgactaacggtcgacgtacgtacgtagtaacgttactacgtacgtaactaactttntaacgttaacgacttaacgtaaagtacgtaactagttaacctcgtacccgttaccgttccgtaccggtaccggttaaccgggacggtacgggtacgggtaacgggtcggtaaaccgtaaccggaaacggtcggtacggtatcccgtaagtccgtaccg

SEQ ID NO: 176028 - DNA, 724 bp, Homo sapiens
  misc_feature: GYAE6OF01DHOU9.51.1.A01.1.454.CMB.1.raw
  modified_base (361)..(361): a, c, t, g, unknown or other
  misc_feature (361)..(361): n is a, c, g, or t
tcagcgatcgtatacacgaccggtgctcgatttagacgtctcatcagggggagtcccaaccaggacacagcatggacatgagggtccctgctcagctccgtggggctcctgctgctctggctcgtcgaggtcgccagtatgtatcatccagtatacgaccctagtcctccacttccctccctgtctgctagtctagtaggagactaagaactccaacctataccgtacggttcgggccgggacgtacggccgaaggacctagtacgcttatgtaatcgtagtaagtttggtaactcgaaagaaaccgaaaaaccggacgggaacccctacccgtaacgtcctacgtaccgtacgttaccgngtactacgactaaccgttaaccgttaaaggttaaccggaaaccggtaccgggtaaccttaacgtaaccggttaacggttacgtagggtaccggacgttaacggtgggtaccgttagggtacgggtaactaaggtttcctttacctacgtttacccactacgtacaccgtaacgtaacgtacgtcgaaccgtacgacggttaagtaaggctttaagaccgtaaactacgtttaactacgtttacacgtaactagtactataagtacttacctccgaccttcgtaaccgtcgggtacggagggtaaacccgggtagtaagggtgtaaacccaggtaaccggtgttacgaggtcaacctcggtacc

SEQ ID NO: 176029 - DNA, 692 bp, Homo sapiens
  misc_feature: GYAE6OF01CW5EZ.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgaccagtctccactcctcctgtcctgcatctaagtaggaagacaagaatccaacctatcctacgttcgggccgggacgagtacagggactagttacggctaagttcggtactacgtaggtaagtttggtaactaacgaacggaaaaccaaaaaaccggtacggggaaaaccctaccccgtaacggtaccttacctacggtacttcccgagtactccggactaacttaccgttaaagtttacggaaacgtaccgggtacctatcgtaaggttcacggtcgagtaacggtcgtcgtacggtacgggtatagttacttacgtactttccaaccgtacgtacgacgtaccgacgtcgtacgaccgacggtaccgttaagaaacggttacttaagtacaactaaactactttaagttactaacgtacctaagtacgtatagtaactacctcgtccctacttacgtacggttaccgggacgggtaacggtacggtaaggggtacggaaacgttaacgaacggttaccgtaggctacgtccgaacgtaccg

SEQ ID NO: 176030 - DNA, 659 bp, Homo sapiens
  misc_feature: GYAE6OF01COTQY.51.1.A01.1.454.CMB.1.raw
  modified_base (199)..(199): a, c, t, g, unknown or other
  misc_feature (199)..(199): n is a, c, g, or t
  modified_base (473)..(473): a, c, t, g, unknown or other
  misc_feature (473)..(473): n is a, c, g, or t
  modified_base (638)..(638): a, c, t, g, unknown or other
  misc_feature (638)..(638): n is a, c, g, or t
tcagcgatcgtatacacgaccggtgctcgatttagacgtctcatcagggggagtcccaaccaggacacagcatggacatgagggtccctgctcagctcctggggctcctgctgctctggctctcaggtgccagatgtatcatccagatcgaccctgtcctccactccctccctgtcctgcatctagtaggacgacgaanaactaccaaccctatccgtacgttcgggccgggtacgagtaccgaggtactattagctagttgtatctagtaagtttggtaactacgaacgaaaaccgaaaaaccgacggggaaaccccgtacccgtaaggccttaccgtagtacctccgtacgtagtccgactaacgtaccgttaaagttacggaaaccggtacgggtacctagtacgtaacggtcgtagtcgacgtaaggtcgtcgtcggtacgtacgtagttcttaccgtacttccaactnactacgactacgtacgtgcctaagtcgtaagactagtactcgaactactattacctagtacaacgtagtagttactagtaaccttaccgtcccttaccgtaccgttacggtaccggtacgggaccggtacggtaacgggttaggaccgtacgtaaacgtacggtntacggctaacgtcgactaccg

SEQ ID NO: 176031 - DNA, 571 bp, Homo sapiens
  misc_feature: GYAE6OF02J2RY8.51.1.A01.1.454.CMB.1.raw
  modified_base (225)..(225): a, c, t, g, unknown or other
  misc_feature (225)..(225): n is a, c, g, or t
  modified_base (424)..(424): a, c, t, g, unknown or other
  misc_feature (424)..(424): n is a, c, g, or t
tcagcgatcgtatacacgaccggtgctcgatttagacgtctcatcagggggagttcccaaccaggacacagcatcggacatgagggtccctgactcagctccttggggctcctgctgctctggcctctcgaggtgccaggatgtatcatccagatcggacccagtctccactccctcctcgtctgccatcctataggagacagaatcaccatcacttggccgggngagtcagggacagttagcatgtacgtcgtgaattggtatcagacaaaacgagggaaacgcccctaagcctacctgatcctcgatgcataccaatttcggaaacaggggtcccagacgtaggttcagtgcaaggtcggctacgtagggactacgtactttacactttcacctatcagcacgactacgcacgtctagaagntacttgactaacattacttactgtactaactaagttatagtaataacttccgtccgtactaccgtaccgtttcggaccggtaacgggaccgtaagggtacgggtactaccgaaaccggtactcggtacgacgttacggacctacccg

SEQ ID NO: 176032 - DNA, 557 bp, Homo sapiens
  misc_feature: GYAE6OF02GYUKS.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccgggcgagtcaggacattagcatgtatctgaattggtatcagacaaaaaccgagggaaacgcccctaagcctacctgactcctacgatgcatccaatttacggaaacacggggtcccatacgaaggttcagtgacaaggtgctcgtgggacagtatttcactttcacctatcagcagactgcacgcctagaatattattgactaaactattaacttactagtacaactagttatagtaattaactcctacccgtctaccgtacgtttccgggacgggtaagggtaacccgtaaggggtacgggtaacttaaccgaaaccggtacgttggtacggacctcggacctaaccgg

SEQ ID NO: 176033 - DNA, 490 bp, Homo sapiens
  misc_feature: GYAE6OF02H6YDY.51.1.A01.1.454.CMB.1.raw
  modified_base (263)..(263): a, c, t, g, unknown or other
  misc_feature (263)..(263): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaanccctaagctcctgatcctcgatgcatccaatttggaaacaggggtccatcaaggttcagtgcaagtggctcgtgggacagatttcactttcaccatcagcagactgcagcctagaagtatattgcaatataattactgtacaacagtatagataactctcccgctctactttcggcggaagggaccgaagggtgggaactacgaaacgtactggtggctggctaacc

SEQ ID NO: 176034 - DNA, 536 bp, Homo sapiens
  misc_feature: GYAE6OF02I4QUY.51.1.A01.1.454.CMB.1.raw
  modified_base (265)..(265): a, c, t, g, unknown or other
  misc_feature (265)..(265): n is a, c, g, or t
  modified_base (381)..(381): a, c, t, g, unknown or other
  misc_feature (381)..(381): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagacaaaaaccgagggaaancccctaagctcctgatcctcgatgcatccaatttggaacagggtcccatcaaggttcagtgcaagtggctcgtgggacagtatttcactttcacatcagcagctgcagcctagaanatattcgacaactatattactgtacaactagtaatgaacttaactcctcccgtcttaccgtaccgttttcgggacgggtaacggggtaccgtaaggggtcgggaacttaccggaaaacggtacgttgggtacggtaccgttacggaccctaaccg

SEQ ID NO: 176035 - DNA, 571 bp, Homo sapiens
  misc_feature: GYAE6OF02ILEPV.51.1.A01.1.454.CMB.1.raw
  modified_base (427)..(427): a, c, t, g, unknown or other
  misc_feature (427)..(427): n is a, c, g, or t
  modified_base (486)..(486): a, c, t, g, unknown or other
  misc_feature (486)..(486): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctagtaattggtaatcaagaaccaaaaaccgaagggaaaacgacccctaagacctacctagacttccctagactgacattaccaatttaggaaacgacggggtacccaatacgaaggttcagtagcgaaaggtggcttacgtgggaactaggtattttctactttacaccatcagcaagactgcagccgtagaanattattcgacaaatattaacttatactacaactagtaatagtaataacgtctacccgtnttaccgacgtttacgggacggtaacgggaaccgtaagggtacggggaactaacgaaacgtaacgtggtcggactcgacctaaccg

SEQ ID NO: 176036 - DNA, 573 bp, Homo sapiens
  misc_feature: GYAE6OF02HI8VH.51.1.A01.1.454.CMB.1.raw
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattagcatgtatctagaattggtatcaagacaaaaaccgagggaaacncccctaagcctcctgactcctcgatgcatccaatttgggaaacncggggtcccatacgaaggttcaagtgctaaggtggctgtgggacaggtactttcactttcaccatcagcagactgacagcctaggaatattattgacaaatattaattaacgtgtacaacgtagttatagaattaaactcccgtacccgtcttacgtaccggttttccgggaccggggtaacggggaaccctaaggggggtacggggaacttaacccggaaaacggttacgtgggttacgggaccttacggacctaaccg

SEQ ID NO: 176037 - DNA, 560 bp, Homo sapiens
  misc_feature: GYAE6OF02HG1YG.51.1.A01.1.454.CMB.1.raw
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattagcatgtatctgaattggtatcagacaaaaaccgagggaaacnccctaagctctgactccngatgcatccaatttggaacacgggtccagtcgaaggttcagtcgacaagtcggctcgtaggactagtactttcactttcgactatacagtcgagtactgactagcctagaagtagttattcgactaactagttaacttacgtagttaacaaacgtagttatagtaacttaacgtcctacccgtacttactaccgttttcgggaccgggtaacgggaaccgtaaggggtacgggtataaccgaaacggtacgttaggtcggacttacggacctaaccg

SEQ ID NO: 176038 - DNA, 501 bp, Homo sapiens
  misc_feature: GYAE6OF02GBGZA.51.1.A01.1.454.CMB.1.raw
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagacaaaaaccagggaaacncccctaaagcctcctgatcctcgatgcatccaatttggaaacnggggtcccatcaagttcagtgcaagtgctcgtggacagtatttcactttcacatcagcagactgcagcctagaagatattgacaacattattactgtacaacagtaatagaattaactctcccgctctacgtttcggacggaacgggaccgaagggtgggataccgaaacgtacgtggtggcttcgctaaccg

SEQ ID NO: 176039 - DNA, 541 bp, Homo sapiens
  misc_feature: GYAE6OF02GZPC4.51.1.A01.1.454.CMB.1.raw
  modified_base (266)..(266): a, c, t, g, unknown or other
  misc_feature (266)..(266): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagacaaaaaccgagggaaacncccctaagcctcctgactcctcgatgcatccaatttggaacagggtcccatcgaagttcagtgacaagtggctcgtgggacagtactttcactttcacctatcagcagactgcagcctagaagtatattgactaactattacttactgtacaacgtagttatagtaattaactcctacccgtcttaccgtacgtttaccgggacgggtaacgggaacccgtaaggggtcgggtactaaccgaaacggtacgttggtacgggtctacgcctaaccg

SEQ ID NO: 176040 - DNA, 578 bp, Homo sapiens
  misc_feature: GYAE6OF02J2IMT.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtatccatcctcctgtctgcatctataggagacagaatcacatcacttgccgggcagtcaggacattagcatgtatctgaattggtatcagacaaaaccgagggtaaagcccctaagcgtcctgactcctcgatgcatccaatttggaaactcggggtacctatcaacggttcagtgacaagtcggctcgtagggactagtactttcacgtttcacatcacggctaacggctgcagcctagaagtatacttagacaactattacttaactcgtactaaacgtagtaatagtaattaaccttaccgtacccgtcgttaacttccggtttaccgggacgggtaaacggggaaccgtaagggggttaccgggtaaacttaaccggaaaaccggtacgtacggttacgggacttcggaccgttaacccg

SEQ ID NO: 176041 - DNA, 517 bp, Homo sapiens
  misc_feature: GYAE6OF02JARVJ.51.1.A01.1.454.CMB.1.raw
  modified_base (405)..(405): a, c, t, g, unknown or other
  misc_feature (405)..(405): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaaccatcacttgccgggcagtcaggacattagcatgtatctagaattggtatcagacaaaaccgaggaaacgccctaagctctgactcctcgatgcatccaattcggaaacgagggtccatacgaagttcagtgacaagtgctgtgggacagtattcactttcactatacagcagactgacagcctagaagtatattgacaatataattacngtacaactagtatgaataactcctaccgacttactacgtttcgggacggtacggtaaccgtagggtacgggactacggaaaccgtagtcggtacggtactacggactaaccg

SEQ ID NO: 176042 - DNA, 702 bp, Homo sapiens
  misc_feature: GYAE6OF02HGRC8.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtcctccatcctccctgtctgcatctataggagacagaatcaccatcacttcggccgggcgagtcgaggacagttagcatgtatctgaattggtatcagacaaaacgaggaaacgccctaagctcctagactcctcgatcgcactacctaagtttacggaaacgtacgggggtacccctaagtacgtaaaggttacctaggttaggtaccgtaaaggttcggtccgttacggtaggggtaacctacggtacttttaccgtaaccctttttacaaccctagttaccgaacgtaccgtaaacggtaccttcggacgtaaccggtcccgttaaggaaacgttacgtttaacgtttacggaacctaaacgttaacttactttaacgttacgttaaccaaactaagttacttagtaacttacggttaccctacccggtcttacccgtaccggttttaccgggggacccggggggtaaccgtaaggggttaccggaacggtaacgtacggtaacggtaccggtaacgttagggtacggttccgtacggtaacccg

SEQ ID NO: 176043 - DNA, 703 bp, Homo sapiens
  misc_feature: GYAE6OF02HNP45.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattagcatgtatctagaattggatcgaagaacaaaacgacggaaccaccctaagcctactagactccgtacgatcgactactactaagttacggaacggtacgggtacccagtacgtaacgttcaggtcgacgtaaggtcggtcgttacggtacggggtaactaacggtttaacttttaccttaaccgtttaccaaacccgtacgtacgaacggtacaacgtacgtacgacgtaccgtaccggtaaagaaacgttaatttagtacggtacctaaattaactttaacgttaactacgttaacctaaacggtattaagttacgtaaaactttacccgtacccgttaccccgtacttaccgttacccggttttacgggggaacccggggtaaacggggaacccggttaaaggggggtaccgggtaaacgttaaaccggtaaacggtaccggttagggtaacgttaccggtacgtaccctaaccgg

SEQ ID NO: 176044 - DNA, 603 bp, Homo sapiens
  misc_feature: GYAE6OF02GWNUI.51.1.A01.1.454.CMB.1.raw
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattagcatgtatctgaattggtatcaagacaaaaacgngggaaacnccctaagctcctgactcctcgaatgctaataccctaaagtttacgggaaaaccgtcggggttaccccagttaccgaaaggttcaaggtgacaaggtggctcgagggtacaggtaactttcctaactttccgaacctatcagcaacgcgtgacagcctaagaagtacttagtcgactaaactattaacgttctagtaccgaactagttaatacgtaacttaacgtcccttaacccgcttacgtacccgggttttcgggaccgggaacggggttaaaccaacggggtttggggaacttaaccggaaacggtcgttacgggtcgaccgttaggccctaacc

SEQ ID NO: 176045 - DNA, 538 bp, Homo sapiens
  misc_feature: GYAE6OF02GX3Y3.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattagcatgtatctgaattggtatcagacaaaaaccgagggaaacgcccctaagctcctgactcctcgatgcatccaattggaaacacgggtcccatacaaggttcagtgacaagtggctcgtgggacagtatttcgactttcacctatcagcagactgacagtcctagaagtatattcgactaactattattactagtacaaacgtagtaatagtaattaactcctacccgtctaccgtacgtttcgggaccgggtagggaaccgtaaggggtgggaactaacgaaacggtacgtggtaggaccgtcggacctaaccg

SEQ ID NO: 176046 - DNA, 588 bp, Homo sapiens
  misc_feature: GYAE6OF02IBAEZ.51.1.A01.1.454.CMB.1.raw
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
tcagcgatcgtatacacgaccggtgctcgatttagacgtctcatcagggggagtcccaaccaggacacagcatggacatgagggtcccctgctcagctcctggggctcctgctgctctggctctcaggtgccagatgtatcatccagatgacccagtctccatccctccctgtctgcatctagtaggagacagaatcaccatcacttggccgggcgagtcaggacattagctatgtattctagtaattggtatacagacaaaaaccgagggaaaccgaccctaagcctacctgtactaccgtcggatcgctactacctaaagtttacggaaacggtccggggtacccagtactaaggttcagtcganaacggtgcctgtaggactagtacttctacttcacntacacgcgtagactgacgactcgtagaagtattattcgactaacagtttactaattcgacaatagtatacgtaacttacgtacctcccgtattaccgtacggtttaccgggacgggtacgggtaacggtaaggggtacgggtaacctaaggaaccggttacgtcgggtgtactacggactaaccgg

SEQ ID NO: 176047 - DNA, 803 bp, Homo sapiens
  misc_feature: GYAE6OF02HX5C5.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctgtctctcaggtgccagatgtatcatccagatgacccagtctccatcctcctgtctgcatctataggagacagaatcaccatcacttgccgggcagtcaggacattagcatgtatctgaattggatcaagacaaaaacagggaaacgacccctaagctcctagactccctacgatcgactactaccaaagttttacggaaaacgtacgggggtaccccaagttaccgtaaagggtttacaacggttaggaccgtaaaggttcgggaccgttacggttacgggggaaccgtaacggttaactttttccgtaacccttttttaccaaaccttacgttaccaacgggtacaacgggaaccttacggaccgtaaaccgggtcccgttaaggggaaacttaaccggtttaatttaaccggaccttaaaaacctagtttaaaccttttaacgttacggttaaaccaaaaccgttaaggtttaaacttaacggttaaactttaaaaccgtttacccttacccccggttaacgtttaacccgttacccgggtttttttaccgggggaaccggggttaaacgggggtaacccccgggtaaagggggtttaccgggggtaaacgtaaccccggttaaaaaacggtaacccggtttaacgggttaccgggtacccgttacggaacccgttaaaccccgg

SEQ ID NO: 176048 - DNA, 626 bp, Homo sapiens
  misc_feature: GYAE6OF02JZ99G.51.1.A01.1.454.CMB.1.raw
  modified_base (270)..(270): a, c, t, g, unknown or other
  misc_feature (270)..(270): n is a, c, g, or t
  modified_base (449)..(449): a, c, t, g, unknown or other
  misc_feature (449)..(449): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatccaccatcacttgccgggcagtcaggtacattagcatgtatctgaattggtatcaagaacaaaaaccgaggggaaacncccctaagcctacctgtaactcctcgatgaccactaccgtaagtttacggaaacgtcggggtaccccaagtacgtaaggttcaggttacgacgaaggttcggacgttcggtacgggaactacggttacttttacaccttttacgacccttagtaccagtaccgagtacgtacgcgtacnccgtaagaagttactattagaactaacgattacttacgtacgtaacaacgtagttatatacgtaacttccaccgtaccttccggttacgttccggacggggtaacggtaacccggtaaggggtacgggttaactaacggaacgttacgtaccgggtggtacccgtacgacctaaccg

SEQ ID NO: 176049 - DNA, 718 bp, Homo sapiens
  misc_feature: GYAE6OF02IJVFI.51.1.A01.1.454.CMB.1.raw
tcagcgatcgtatacacgaccggtgctcgatttagacgtctcatcagggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctagaattggtatcagacaaaaaccgagggaaacgccctaagcctaccgtgactcctcgatgacatccaagtttaggaaacgtacggggtacccatacgtaaggttcaggtgacaaaggtcggcttcggtacgggaactaggttaacttttcctaccgttttacaaccctaattaccgaacggtacctaaggtaccgttagccgtaacggtacccgttaggaaaggttaatttacgtttacgaccgtaaacctaatttaaacgtttaacgttacgttaaccctaaaacgtaaggttaacttaacggtaaactttaaaccgttccccgttacccccggttactttaacccggttaccggtttttccgggggaacccgggggtaacggggtaaaccccgggtaagggggttaaccgggggttaaccttaaacccggtaaaaccggtaacgtttagggtaccggggtacttaccggaaccgtaacccg

SEQ ID NO: 176050 - DNA, 835 bp, Homo sapiens
  misc_feature: GYAE6OF02IZ6Q1.51.1.A01.1.454.CMB.1.raw
tcagcgatcgtatacacgaccggtgctcgatttagacgtctcatcagggggagtcccaaccaggacacagcatggacatgagggtccctgctcagctccgtggggctcctgctgctctggcctctcaggtgccgagatgtatcatccagatcgacccagtctccactccctccctgtctgcattctagtaggagacagaactcacctatacctacgttcggccggggacgagtaccgaggactagttagcatgtatctagtaagttggtatacacgaacgaaaaaccggaacgggaaacctacccgtaagccttaccgtagtaccgtacctcgatcgactaactaccgtaagtttacggaaaccgtacggggtacctaacgttacgtaaacggttacgtaacggttacgacgtaacggtcggtacgttaaccgggtcgggtaaacgtaacggttaacgtttttaccgtaacccgttttaacgtaaccctaacgtaccgtaacgttaaccgaagtttaaccgacggttacgaaccgggtccctaaacggtaaggttaaactttacggttaacggtaaacctaaccgtttaaacgtaacgtttaacttaaccggttaaaccaaaccgtttaagggtttaaactagttaaaaccggtttaaccttaccccgtaacccggttacccgttaaccgtttacccgggtttttaacgggggaaccccgggggtaaacggggttaaaccggtaaacggggggtttaacggggaaaccgttaaccgggttaaaaaccggaccgtttaaacgggtacggtaccggttaccggtacccgttaacccg

SEQ ID NO: 176051 - DNA, 586 bp, Homo sapiens
  misc_feature: GYAE6OF02FJK48.51.1.A01.1.454.CMB.1.raw
  modified_base (269)..(269): a, c, t, g, unknown or other
  misc_feature (269)..(269): n is a, c, g, or t
tcagcgatcgtatacacgaccggtgctcgatttagacgtctcatcagggggagtcccaaccaggacacagcatggacatgagggtccctgctcagctcctgggggctcctgctgctctggctctcaggtgccagatgtatcatccagatgacccagtctccatcctccctgtctgcatctataggagacagaatcaccatcacttgccgggcagtcaggacattagcatgtatctgtaagttggtatcagacaaaaaccgagggaaacncccgtaagctacctgactcctcgatgcatcctaagtttacgggaaacgtacggggtacccaagtacgtaaacggttcaggtgactaaggtggctcgtgggacagtatttcactttcacctatcagcagtactgactagcctagaacgtatacgttacactaaatattacgttactgtaacaagtagttatacgtaataacgttcccgtacctaccttcgtacccgttcgggacgggtaaacgggtaaccggtaagggggtcgggtaaccgtaacgtaaacggtacgttagggtacggtaccgttcggaaccctaccg

SEQ ID NO: 176052 - DNA, 617 bp, Homo sapiens
  misc_feature: GYAE6OF02F0GKU.51.1.A01.1.454.CMB.1.raw
  modified_base (262)..(262): a, c, t, g, unknown or other
  misc_feature (262)..(262): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcacatcacttgccgggcgagtcaggacattagcatgtatctgaattggtatcagacaaaacagggaaacncccgtaagcctacctgactcctacgatgcatcctaatttacggaaacgacgggtcccaagtacgaaggttcagtgacgtaagtggactcgtgggacagtatttcctactttcactatcagcagctgacagcctagaagtaattgttacgactaaacgtattaagtttactacgtaactaaacgtagttaagttacgtaagttaacctcccgttacccgaccttaccgttaccggttttccgggaccggggttaaccggggtaacccgtaacggggggttaacggggtaaccgttaaccggtaaaaccgggttaccgtttacggtaccgggtccttaaccgggacccttaacccgg

SEQ ID NO: 176053 - DNA, 612 bp, Homo sapiens
  misc_feature: GYAE6OF02I43LO.51.1.A01.1.454.CMB.1.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagcgatcgtatacacgaccggtgctcgatttagacgtctcatcaggggagtcccaaccaggacacagcatggacatgagggtccctgctcagctccgtggggctcctgctgctctggctctcaggtgccagatgtatcatccagatcgacccagtctccattcctccctgtctgcatctagtaggagacagaatcaccatcactggccggcgagtcgaggactagttanctatgtatcgtagtaattggtatacgaagaactaaaaaccgaggggaaaccncccgtaaagcctacctagtactcctgatcgctactactaaggttaggaacgtcgggtaccatacgtaaggtcaggtnacgtaaggtcgctcgnggatacgtatttaccactttccgacctatcagtcgagtacgngacngtacgtagtaacgtatacgttgaactaactatttaactacgttacgaactaacgtattagattaaccgttactcccttccgtacttccgttaacgggttccgggaacgggtcgggtaaccggtaaaggggttcgggtaaacctaacggtaaacggtacggttacgtacgggtccttacggaccttaaccg

SEQ ID NO: 176054 - DNA, 784 bp, Homo sapiens
  misc_feature: GYAE6OF02GWMYH.51.1.A01.1.454.CMB.1.raw
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctatagganacagaactcacatcacttgccgggnagtcaggacattacgctatgtatcgtagtaattggtactcgaagtacctaaaaaccgagggtaaacgaccccgtaaagcctacctgtaactcccgtcggtaattcgacctaattaccctaaagttttacgggaaaacgtacggggtaccctaagttacgaaagggtttcaaggttacgacgtaaaggtcggtacgttcgtagggggtaacctaggtttaacgttttacctaacgttttaccaacctacgtaccgaagcccgtaacggtaccgttacggacccgtaacggtccccgttaagggtaaacgttaacgttaagtttacggaaacctaaacgtaactttaaccgtttaaacgtttacgtaaaccgtaaacgttaacgttaacgttaacggtaaactttaaacgtccccgtttacccgtaaccgtttacccggttaacccgtttttccggggaaccggggtttaaacgggggtaaccccgttaaaggggggttacggggttaaacctaaccgggtaaaaccggttaaccgttacggggttcggtaacccgttacggtacccgtaaacccg

SEQ ID NO: 176055 - DNA, 774 bp, Homo sapiens
  misc_feature: GYAE6OF02HZ4VT.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatgacccagtctccatcctccctgtctgcatctataggagacagaactcaccatcagttcggccgggacgagtcaaggactattagcatgtatctagaattggtatcgaacgacaaaaccgagggaaaacgacccctaacgcctaccgtacgactccgtacgatcgactaactaccgtaaagtttacggaaaaccggtcggggtacccctagttacgtaaaggttacgaggtacgacgtaacggttcggacgtcgtagggacctaaggttactttaccttaacgttttaccgaacctaacgtaccgaacgtaccgtaacggtaacgtcggtaccgtacggtacccggttaaggtaaaacggtaaacttttacgtaacggttaaacctaaacgttaaactttaaccgttttaaccgttacggttaacctaaaccgttaaggttaacgtaacggttaaatttaaaacccgttccggttaaacccccgttcgttaacccgtttaacccggtttccgggggtaaaccgggggtaaccggggtaaacccgggtaagggggttaaccggggtaaacttaaccggtaaaaccgggttcgtaacgggttccggtaaccggtacgtaccgtaacccgg

SEQ ID NO: 176056 - DNA, 719 bp, Homo sapiens
  misc_feature: GYAE6OF02H51YS.51.1.A01.1.454.CMB.1.raw
  modified_base (512)..(512): a, c, t, g, unknown or other
  misc_feature (512)..(512): n is a, c, g, or t
  modified_base (613)..(613): a, c, t, g, unknown or other
  misc_feature (613)..(613): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccagtcctccatccctccctgtctgctatctagtaggagacagaactcacatctacgttcggccgggcgagtcgaggtactagttagctattcgtatctagtaagtttggtaatacgaagaaaccgaaaaaccgacggggaaacctaccccgtaacgccttaccgtagacctcctacgtatcgacctaactacgtaaagttaacgggaaaccggtcggggttaccccaagttaaccgtaacgggtttcaaggtcgtacgtaaggtcggtaccgttcgggtaggtaaccgtagtttacctttacctttaccgttaccaaacccgttgtaccgtaggtaccaagtccgtacgccgtaaccgtntaaacggaagttctttaacgtacgaaaccttaaatactttaacctttacgtacgtaaactacgtaggttaactagttaacttaaccctccgtaccccgttntaacccgttaccgttcgggggaccgggtaacggtaaccggttaagggggtacgttaaacaccggttaaccggtagttacgggtaccgtcgtaccggactttacccg

SEQ ID NO: 176057 - DNA, 668 bp, Homo sapiens
  misc_feature: GYAE6OF02IZU1K.51.1.A01.1.454.CMB.1.raw
  modified_base (461)..(461): a, c, t, g, unknown or other
  misc_feature (461)..(461): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccagtctccatccctccctgtctgctatctagtaggagacaagaactcaccatcacgttcggcccgggacgagtccaggacattagctatgtatctgtaattggtatacgaacgaacaaaaaccgacgggaaactacccctaaggccttaccgtagaccttaccgtacggtactcgacctatacctaagtttacggaaacgtaccgggtacctagtacgtaacggttcaagtacgactaaggtcggtacttacgtaggactacgttaactttccgttacttaccacctactacacgctacgacgtcgacncggtacctaacggaattaagttatacgaaactaactaagtttaacttaactacggttaacaagtaacgtttagaacgttaacttaaccttccgtaccccgtaccttaccggtacggttcggtaaccgggaacgggttaacccggtaagggtacgggtacgtaaccggttaacgaaccgggtttaggacgttaccgacgtacgtaccc

SEQ ID NO: 176058 - DNA, 655 bp, Homo sapiens
  misc_feature: GYAE6OF02HSU2N.51.1.A01.1.454.CMB.1.raw
  modified_base (183)..(183): a, c, t, g, unknown or other
  misc_feature (183)..(183): n is a, c, g, or t
tcagcgatcgtatacacgaccggtgctcgatttagacgtctcatcaggggagtcccaaccaggacacagcatggacatgagggtccctgctcagctccgtggggcctcctgctgctctggctctcgaggtcgccagatgtatcatccagactcgaccctatcctccactccccttcctgttcncgctatactagtaggaacgacagtactacacctatccgtagtcggacgggctagacgagactagtagctatgtactctagtagtttggatagaacgaaccgaaaaccggacggaaacccgtacccaagtccttacgcgtactcgtacatcgtactaacgtactaagttaacgggaacgaccggtacctagtacccggtaaggttcgtaaggctaacggtaacgggttcgtacgtacgtacggtacctaggtttaccttacttacctttcgactacgtacacgtcaacgcgtacgacacgtacgtagaagttactatacgaactatactacgtactaacgtactaacgtagttataactacttacgtcctacccgtagttcccgtacgtttcgggacgggaacggtaccgggtaaggtacgggtaacctaacggtaacgtccggttagggtaccgtcggtacctacgtaaccg

SEQ ID NO: 176059 - DNA, 770 bp, Homo sapiens
  misc_feature: GYAE6OF02JMVY4.51.1.A01.1.454.CMB.1.raw
  modified_base (203)..(203): a, c, t, g, unknown or other
  misc_feature (203)..(203): n is a, c, g, or t
tcagcgatcgtatacacgaccggtgctcgatttagacgtctcatcaggggagtcccaaccaggacacagcatggacatgagggtccctgctcagctccgtggggctcctgctgctctggcctctcaggtcgccagatgtactcactccagactcgaccctagtcctccactccctcccttgtctcgactatactagtaggaanacaagactaccacctactacgtaccgttcggccgggacgtacggtccgaacggtactaagttacggacttaagttcgttactacggttaagttaagtttcggtaaactaccggaaacgaaaacccgtaaaaaccgggaacggggtaaacccacccgttaacggccctaccgtacgtaacctccgtaacgtactaccgtactaaccgttaccttaaacgggttacgggaaaccgggtccggtaacctaagtacggttaacgtactacggtacgtaacgtacgggtcgtacgttacgggaacggttaacgtaacttaccgtttactaccttacccaacgtactacgacgtacgtactagacgtacgtaccgtacgtaaggtaataacgttacgttaacgaaccttaattactacgttaacgtacgttaacaacgttaagtacgttaacgtaccgttaccctaccgtaccgtacgttaccgttacggtaccgggtaacgggaaccgggtaagttacggggactaaccgttaacgacgtacggttacggccgtaacgttcgaacccgttcg

SEQ ID NO: 176060 - DNA, 891 bp, Homo sapiens
  misc_feature: GYAE6OF02FVO2N.51.1.A01.1.454.CMB.1.raw
  modified_base (866)..(866): a, c, t, g, unknown or other
  misc_feature (866)..(866): n is a, c, g, or t
tcagcgatcgtatacacgaccggtgctcgatttagacgtctcatcagggggagtcccaaccaggacacagcatggacatgagggtccctgctcagctccgtggggctcctgctgctctggctctcaggtgcagatgtatcatccagatcgacctagtcctccacttccctccctaggtcctgactattactaagtagggagaacaagaactccaactactcctacgttcggccgggacgtagtccgaaggactagttacgactaacgttgtaacttccgttaagtaagtttcgggttaactaaccgaacggaaaaccgtaaaaaacccgggaaccgggggtaaaaacccggtaccccttaaacggtcccgttaccccgtagggtaacctttccccgttacggacgtttaccggaccttaaaccgttaacccgttttaaacgggttaacggggttaaaaacccggtacccgggggttaaccccttaaaacgttacccggttaaaacggggttttccgtaaacgggttaccggtaaccgggttaaacgggttcggggtaaacccgttgggggtaaacccgggggtaacttaaaccgggtttacttttacccgttaacccgttttaacctaccgttagtaccgttaacggacgaacgttaccggtcgaaccgccggtaacgtaggtaacgtattacggtaactacctaaagtaaccgtttgtacgttacgtaacgtaagtaaacgttacgttaacgtaaccttacttacccggtacccctagttaccgggttaccgttccggggaacgggtaccgggtaaccgggtaaggtaaccgggtacgtaacgtaacggttacggttaacccggnggttaccccggactaccggttaccg

SEQ ID NO: 176061 - DNA, 661 bp, Homo sapiens
  misc_feature: GYAE6OF02GPD1S.51.1.A01.1.454.CMB.1.raw
  modified_base (154)..(154): a, c, t, g, unknown or other
  misc_feature (154)..(154): n is a, c, g, or t
  modified_base (159)..(159): a, c, t, g, unknown or other
  misc_feature (159)..(159): n is a, c, g, or t
  modified_base (337)..(337): a, c, t, g, unknown or other
  misc_feature (337)..(337): n is a, c, g, or t
  modified_base (654)..(654): a, c, t, g, unknown or other
  misc_feature (654)..(654): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccngtccnccactcctccctgtctgaccatactataggagacaagtaactccaaccataccacgttcggcccggggacgaagtccgaagggaactatttacgacctattaggtattactagtaaagtttggtactacgaacgaaccaaaaaccgacggggaaacctacccctaaaggccttacccngtaccttcccgtagtactcgactaacttacctaaaggtttccggaaaccgtacgggtaccctagtaccgtaaggttaccaggtacgaccgtaaggtcgggtaccttacggtacgggaacttaggttaccttttaccgtactttccaaccgtatacgacgtacgacgtctcgacgtacgtcccgtagaagtattactgacttaacactttagttactagtacctaagtacgtaatacgtactaactccgaccgtctacgttacggtccggacggacgggtacaagggtcggaactacgaacgtgtcggtacggctacncgtaccg

SEQ ID NO: 176062 - DNA, 604 bp, Homo sapiens
  misc_feature: GYAE6OF02I48EY.51.1.A01.1.454.CMB.1.raw
  modified_base (221)..(221): a, c, t, g, unknown or other
  misc_feature (221)..(221): n is a, c, g, or t
  modified_base (315)..(315): a, c, t, g, unknown or other
  misc_feature (315)..(315): n is a, c, g, or t
tcagcgatcgtatacacgaccggtgctcgatttagacgtctcatcaggggagtcccaaccaggacacagcatggacatgagggtccctgctcagctcctggggctcctgctgctctggctctcaggtgccagatcgtatcatccagactgacccagtctccatcctcctgtctagctatctagtaggagacagaactcacctattacacgttggccggganagtaccaaggactatttaggactatgtaatcgtagtattcggtaatcgaagaacaaaacgaggaaccaccctaaggtcctcctagacttaccgngacttacgacacttacctaaagtttacggaacgtacgggtaccaagtacgaagttcagtcgtataacggtgacttcgaggtacacgttattccacgtttcactagtacagcgtacgactacggactacgcgtaagaatactaacttagtaacctaactacttaacgtaacttaccgagtaactaagtactaggtaactactaccgcctatccgtaacgttccgggacgtagtccgggaaagtccgggaacttacgaaacggtattcgggacccttaggactacgtaacg

SEQ ID NO: 176063 - DNA, 667 bp, Homo sapiens
  misc_feature: GYAE6OF02GCN9R.51.1.A01.1.454.CMB.1.raw
  modified_base (214)..(214): a, c, t, g, unknown or other
  misc_feature (214)..(214): n is a, c, g, or t
tcagcgatcgtatacacgaccggtgctcgatttagacgtctcatcagggggagtcccaaccaggacacagcatggacatgagggtccctgctcagctcctggggctcctgctgctctggctctcaggtgccagatgtatcatccagatgacccagtctccatccctcctgtctgcatctagtaggagacagaatcaccatcacttggcccgggnagtacaggacattacgctatgtatctagaattggtatacgagaaccaaaaaccgagggaaacgtccccgtaagtccttcctagacttccctacggatcgacctaacgttaccgttaaagtttacggggaaaaccgtacgggggttacccaacgttacgaaacggtttccgaagggtttcgaccgtaaggtcggtacctcggtacgggaactagttacttttcctaacgtttcaacccgtatccgtaacgcctaaacggtccttacgaccgtaacggtacctaggtaaacgtatttacgttagaacctaacgtaatttaacgttactacgtacaacgtagtagttacgattaacctccgtaccgtctaccgttacggttcgggacggaacgggtaaccgtaagggtggtaaccgtaacgaacgtacggttaggacgtacggtcgaccgtaaccg

SEQ ID NO: 176064 - DNA, 910 bp, Homo sapiens
  misc_feature: GYAE6OF02HPBWE.51.1.A01.1.454.CMB.1.raw
tcagcgatcgtatacacgaccggtgctcgatttagacgtctcatcaggggagtcccaaccaggacacagcatggacatgagggtccctgctcagctcctggggctcctgctgctctggctctcaggtgccagatgtatcatccagatcgacccagtcctccactcctccctgtctgctatctagtaggacgacagaactccaccatccacgttcggccgggacgagtcgaacgtacacttaccatagtatcgtagtaagttgtactacgaacgtaacaaaaaccggacgggtaaacctaccccgtaacgtcctaccgtagtaaccgtccgtacggtcgtacgtaccgtaccttaaccgttaacggtttaaaccgggtaaacccggtaccgggggttaccctaaacggtttaaccggtaacggttaccgttaaggggtacggaaacgtaacggggttacggtaccggttacgggttacgggtaacgttaacggtttaaccttttaacccgtttaacccgttttacccgtaacccttaacggttacccgtaaacgtaccggtaaaccggtaccggttaacgacccgtaacgggtaacccgttaacgggtaaacgttaacgtttaaacggtttaaccgtaaaccggtttaaaactaacgttttaacgtttaaacccgtttaaccggtttaaaccgtaaacggtttaactttaaacggtaacgtttaaacgtttaccccggtttacccgttaccccggttaccctttaaccggggtttccgggtttaaccggggaaccgggggttaacccgggtaaccggggtaacgggggtttacggtaaaccgttaaccggtaaaccggttaccgggttaacgggtaccggttaccggtaacgtacccggttacgttaccgg

SEQ ID NO: 176065 - DNA, 775 bp, Homo sapiens
  misc_feature: GYAE6OF02FLBTC.51.1.A01.1.454.CMB.1.raw
  modified_base (660)..(660): a, c, t, g, unknown or other
  misc_feature (660)..(660): n is a, c, g, or t
  modified_base (768)..(768): a, c, t, g, unknown or other
  misc_feature (768)..(768): n is a, c, g, or t
tcagcgatcgtatacacgaccggtgctcgatttagacgtctcatcagggggagtcccaaccaggacacagcatggacatgagggtccctgctcagctccgtggggctcctgctgctctggctctcaggtgccagatgtatcatccagatacgacctagtctcctactccctccctgtctgactacttacgtaagtaggaacgacgaagtaactaccaacctataccgtaccggtttccggggaccccggggtacggtacggttaccgaacgggtaaccttaagtttaacggactaagttggttaacttacgttaggttaacgtttaggttaacctaaccgaaacggaaaacccaaaaaccgggaacgggaaaccctaccctaaaggtccccttacgtacgtaccgttacccgtacggattcgacctaacgttaaccgttaaaggttaccgggaaaccggtaccggtacctaagttaccggtaaacggttcctaagggttaccgaacggtaacgggttccgtaccggttacgggtaggtaacgtacgtttacctttccttaaccgttaccaacgtcgtaacctcggaaccttacggacgtcaccgttacgggacttaggaaacttagttaccaacgtactaaacttatttactcggttaanaacgttagtaagttacgtaattacgaccttcccgtccacgtttcgttaccgtaccgggagggtaccgtaacggagggtcctaactacggtacgtggtacgacggactnaccctag

SEQ ID NO: 176066 - DNA, 520 bp, Homo sapiens
  misc_feature: GYAE6OF01AM8O2.33.34.D01.1.454.CMB.1.raw
tcagtacacacactcacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgccctgactcaacctgcctccgtgtctgggtctcctggacagtcggtcaccatctcctgcactggaaccagtagtgacgttggaggctatgactatgtctcctggtaccaacaacaacctggcaaagcccccaattattgatttctgatgtcactaatcggccctcaggggtttctcatcgcttctctggctccaagtctggcagcacggccctccctgaccatctctgggctccaggctgaggacgaggctgtttattactgctgcccgtatacattcagcagctctctcgaattcggcggagggaccaagggtcgaccgtcttaaggtcacgcccaaggcctacgcccccgtgtccactcccg

SEQ ID NO: 176067 - DNA, 528 bp, Homo sapiens
  misc_feature: GYAE6OF01AZTBG.33.34.D01.1.454.CMB.1.raw
  modified_base (518)..(518): a, c, t, g, unknown or other
  misc_feature (518)..(518): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacattggtggttatcaccgtgtctcctggtaccaacaacacccaggcacacgcccccaaactcatactttatgaggtcactaagccgccctcgacgggtccctgatcgcttctctggctccaagtctgacaacacggcctccctgacccgtctctgggcctccgaggctgacgatgaggctgtattattattgctagttcatacggagcaacaacaatctacttagttcggcggaggaccagctagaccgtctaagcacgcccaaggcctcgccccctggtccncgtccgtccg

SEQ ID NO: 176068 - DNA, 759 bp, Homo sapiens
  misc_feature: GYAE6OF01AFH8P.33.34.D01.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
tcagtacacacactcacgaccggtgctcgatttagatcgtctgtgttgggtttggggggggtctcaggaggcagaactctgggtgtctcaccatggcctggatccctctacttctcccctcctcactctctgcacaggctctgcggcctcctacgagctgacacagccaccgtcggtttctgtgtcacgtgggacaggacggccgagcncactgctgaggantcgactagtcgaacgaagactaacgtacgtacgtttagttacggacagacgaagaccgacgaccggaccgaccgtccctagtacgtagtaattaaagtaactaaaacgaaagtaagtaagtaggaacggacccggtacccgtagggaacggtaccttacccggtaggaccgtaccgtttaccgttcccggtaccggtaccttaaacgaacgtcggaacggaacggaaccaacgtacgtacgttacggtacaacctacgtacggtagggtacggtacccgtacggacggacggtaaaacggacggacgggtacgtactaacgtaaccttacgaccctacgtaccgacccgtactaccggacgggtaaccccggtacttagggtacgggggtttacggggtagggttcgggttaccggcggggaacgggtaacgtaccgtttaagggtcccgtaccgttacgggacgtaccggacccggtacccggtagtcccgtacccccggtacccggttcgaccctaccgtttcgttaaccccccg

SEQ ID NO: 176069 - DNA, 520 bp, Homo sapiens
  misc_feature: GYAE6OF01DYJOD.33.34.D01.1.454.CMB.1.raw
tcagtacacacactcacgaccggtgctcgatttagatcgtctgtgttgggtttgggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacattggtggttatcaccgtgtctcctggtaccaacaacacccaggcacagcccccaaactcatactttatgaggtcactaagcggccctcaggggtccctgatcgcttctctggctccaagtctgacaacacggcctccctgaccgtctctgggctccaggctgacgatgaggctgattattatgcagttcatacggaggcaaacaacaatctactttattcggacggaggaccaagctgaccgtctaagtcagcccaaggctacgccccctggtccactctaccg

SEQ ID NO: 176070 - DNA, 550 bp, Homo sapiens
  misc_feature: GYAE6OF01DA7O8.33.34.D01.1.454.CMB.1.raw
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagtctgccctgactcaacctgcctccgtgtctgggtctcctggacagtcggtcaccatctcctgcactggaaccagtagtgacgttggaggctatgactatgtctcctggtacaacaacaacctggacaaacgcccccaattattgatttctgatgtcactaatcgcctcgtagggtttctcatcgtcttctctggctccaagtctggcagcacggcctccctgaccatctcgtcgggcctccgaggctggacggacgaaggcttagtttattactgctcgtccctatactattcagcagtctctctacgtagttcggacggaggaccgaaggtcgtaccgtattaacgtcaacgacccgaacggtcctaccgcccccgttcggtcctccgttcccg

SEQ ID NO: 176071 - DNA, 540 bp, Homo sapiens
  misc_feature: GYAE6OF01DGHPQ.33.34.D01.1.454.CMB.1.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcacctcctcactcagggcacagggtcctgggcccagcctgccctgactcagcctccctccgcgtccgggtctcctggacagtcagtcaccatctcctgcactggaaccagcagtgacagtttggtgttancaccgtgtctcctggtaccaacaacaccagcacagcccccaatcattacttangaggtcactaagcggccctcgagggtcccngactcgcttctctgctacaagtctagaacaacgaccggccctccgcgaccgttctcgtcgggcctccgaggctagacgtatcgaggcttagtaatttattattgctagttcatacggagacaacaactatcttnttagtcggnggacggaccaagccgtgacccgtctaagcacgaccaaggcctcgacccctggtctccgtgtccccg

SEQ ID NO: 176072 - DNA, 573 bp, Homo sapiens
  misc_feature: GYAE6OF01AMTJE.33.34.D01.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagtacacacactcacgaccggtgctcgatttagatcgtctgtgttggggtttgggggggtctcaggaggcagcgctctcaggacgtcaccaccatggcctgggctctgctcctcctcaccctcctcactcagggcacagggtcctgggcccagcctgccctgactcagcctccctcgcgtccgggtctcctggacagtcagtcaccatctcctgcactggaaccngcagtgactattggnggttatcaccgtgtcctcctggtacccaacaacacccaggcacacgcccccaaatcatactttangagtcactaagccggccctcgaggggtccctgatcgcttctctggctccaagtctgacaacacggcctccngacctctcgtgggcctcgaggctgacgntgagtctagattattaatcgactagttcaagtaccggagaccaaactaacctacttacttacttagttccgggacggtaacgggaccaaagtcgtacgtacccgtcgtaaacgtccgacgtaccccaaaggtcctacccgccccgttaggcctacgttcccgtcccg

SEQ ID NO: 176073 - DNA, 562 bp, Homo sapiens
  misc_feature: GYAE6OF01D87VZ.33.34.D01.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
tcagtacacacactcacgaccggtgctcgatttagatcgtctgtgttggggtttggggggggtctcaggaggcagcgctctcaggacgtcaccaccatggcctgggctctgctcctcctcaccctctcactcagggcacagggtcctgggcccagcctgccctgactcagccctccctccgcgtccgggtctccgtggacagtcagtcaccatcctcctgcactggaaccngcagtgactgttggtgttancacgtntctcctgtaccaacacaccagcacacgccccaactctanatttangagtcactgagcggcctcgacgggtccngactcgtcttctcgtgctcgtaagtcncggtaccaacgaccggtccctcctcgacctactcctcgtcggtcctcgaggctgagagtgacgtctgtattagtctgcagtctgtagtcgacgagggcgactaacgtaagtttacgggtgtccgggacgggtacggaaccgagggtccgtacgttaccgtaagccgacgacccggaacgtcccgtaccgccccgtgccgtacccg

SEQ ID NO: 176074 - DNA, 648 bp, Homo sapiens
  misc_feature: GYAE6OF01BFQDT.33.34.D01.1.454.CMB.1.raw
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctcgccgtccgggtctcctggacagtcagtcaccatctcctgcactggaaccagcagtgactagttggtggttatcgaccgtgtctcctcggtaaccaacaacacccaggccacaccgaccccaaactcattactttatcgacgtcaactaacgccggccctcgacgggtcctgatccgcttctctcggctcacgtctcgacacncgccctcctcgacatcncgtcggcctcgaggtcgtaggaggtatagggacgtcgtagtactttacgttacgtgacgtacgtccgtacgttagtcgacggtacggccgtaacctaaaggttaaaggtttacggggttacgggttaccggggacgggtaaccgggtaaccggtaacgggtcccggtaacccggttaccgtaacggtcccgaacggaccccgtaacggtcccgacccggttacccccgttcggtcccgtaccgttccccgg

SEQ ID NO: 176075 - DNA, 540 bp, Homo sapiens
  misc_feature: GYAE6OF01CMJ0D.33.34.D01.1.454.CMB.1.raw
tcagtacacacactcacgaccggtgctcgatttagatcgtctgtgttgggtttggggggggtctcaggaggcagcgctctcaggacgtcaccaccatggcctgggctctgctcctcctcaccctctcactcagggcacagggtcctgggcccagcctgccctgactcagcctccctccgcgtccgggtctcctggacagtcagtcaccatctcctgcactggaaccagcagtgactattggtggttatcacgtgtctcctggtaccaacaacacccaggcacacgcccccaaactcattacttatgaggtcactaagccggccctcgacggggtccctgatcgcttctctggctacaagtctagaccaacaccggccctcccgtgacccgttctcgtcgggcctccgaggctgacgatgagctgtatttatattgctagttcagtacggagacaacaactatctacttagtcggcggaaggaccagcgtacgaccgtctagtacacgcccaaggcctccgccccctgtcctctcgtcccg

SEQ ID NO: 176076 - DNA, 584 bp, Homo sapiens
  misc_feature: GYAE6OF01BNRFF.33.34.D01.1.454.CMB.1.raw
  modified_base (308)..(308): a, c, t, g, unknown or other
  misc_feature (308)..(308): n is a, c, g, or t
  modified_base (570)..(570): a, c, t, g, unknown or other
  misc_feature (570)..(570): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgactagttggtgttatccgaccgtgtctcctggtaccaacaacaccaggcacacgcccccaaactcatactttangaggtcacgtaagccggccctcgacggggtcctgactcgtcttctctggcctaccaagtctacgaaccaacgaccggccctcccgtcgacccgttctcgtcggggcctccgaggtctgacgtagtggaggtctgtaatttattattgactagttacagtaacggaggacaaacaacaattctacttacgttcgggacggacggaacaagccgtagaccgtactagcgacgcccgtaaggcctaccgcccccgttacggtccnccgttccgtacccg

SEQ ID NO: 176077 - DNA, 607 bp, Homo sapiens
  misc_feature: GYAE6OF01C1T4L.33.34.D01.1.454.CMB.1.raw
  modified_base (507)..(507): a, c, t, g, unknown or other
  misc_feature (507)..(507): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacgagggtcctgggcccagcctgccctgactcagcctccctccgcgtccgggtctcctggacagtcagtcaccatcctcctgcactggaaccagcagtgactagtttgggtggttactcgaccgttgtcctcctcggtaaccaacaacactcaggccacaccgacccccaaactcaattactttagtgacgtcaactaagccggccctcgacgggtccctgactcgtcttctcgtcggtctccgaagtctacgactaaccgaccggtcctccgtcgtacccgtctcgtcgggcctccgacggtctacgacgtagtcgaggtcttagtaatttattagttcgactagttcaagtacggagacaactaactnttacttacgttacgtcgggacggaacggaccagtcgtacggtaccgtctaacgtccgacgtacccgaacggtcctacccgtaccccgtcgtctcgtcccg

SEQ ID NO: 176078 - DNA, 647 bp, Homo sapiens
  misc_feature: GYAE6OF01AM0EK.33.34.D01.1.454.CMB.1.raw
  modified_base (307)..(307): a, c, t, g, unknown or other
  misc_feature (307)..(307): n is a, c, g, or t
  modified_base (419)..(419): a, c, t, g, unknown or other
  misc_feature (419)..(419): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccgccatcctcctgcattcggaaccagccgtgacgttggtaggttataagtatcgtcctcctggtaccaacagccaacccagccaaacgcccccaaatcttnatttatgagtcacgtgacgcggccctgacgggtccctgacgtccgtcttctcgtggtcctaccgaacgtcgtacgggaccaaccgtaccggtcccctcccgtacgaaccctntccgtcgtacgggtcctccgaggtctggaggtatggacggtcttagtaactttacgtacctgtactacgtcgttacgtacgtcggaccgtaacggccggtaactaaacgttaaggttttaacggggtcgttacgggacggtaacggaccgtaacggtcgacccgttacgtaagtccgacgaccccgaaggccctacccggcccctacggtcctacgtccgttaccccg

SEQ ID NO: 176079 - DNA, 798 bp, Homo sapiens
  misc_feature: GYAE6OF01BQ80A.33.34.D01.1.454.CMB.1.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacgagggtcctgggcccagcctgccctgactcagccctccctccgcgtcccggtctcctggacagtcngtccacctatcctcctgcacgtcggaaaccagcagtgactagtttgggtaggttacnccgtaaccgttcgttcctacccgtacgggttaaccccaaaaccgaaccaaccccgaggacccaaccgaaccgaacccccccaaacttacctaactttacgttttaatacggtacggtacctaacgttaacggccggtccctcggaccgggttccctagtactcgtccttcctcgtcggtcctaccgtaacgtctacgaccaaccgtacccgtccctccgtcgtacccgttccgtcgtcggtcctccggacggtctacgaacgagtaggacgggtacttagtttaactttaatttagttcgtacgtacgttaacgtaacggttaacgggaacgtactaaaacgtaaactaacgttaccgtttaacgtttacgggtaaccgggtaccggtaacggtacccgtaaacggtcccgttaaccgggttacccgttaacggtaaccgttacccgaacccgggtaccccgtaaacgggtccccgttacccccggtcccccgggttaccggtaccccttaccccggttcccggtttaccccccgg

SEQ ID NO: 176080 - DNA, 663 bp, Homo sapiens
  misc_feature: GYAE6OF01CJN7N.33.34.D01.1.454.CMB.1.raw
  modified_base (345)..(345): a, c, t, g, unknown or other
  misc_feature (345)..(345): n is a, c, g, or t
tcagtacacacactcacgaccggtgctcgatttagatcgtctgtgttggggtttgggggggtctcaggaggcagcgctctcaggacgtcaccaccatggcctgggctctgctcctcctcaccctctcactcgagggcacgagggtcctgggcccagcctgccctgactcagccctcctccgcgtccggtctcctggacagtcagtcaccatcctctgcacgtggaaccagctaagtcgaactagtttgggtagtttaactccgtaccggttgttcctccgttacggtaaccaaacaacacccgaaggccaacaccgaccccccaaaattcctaatttaactttanacggtacgtaccaacgtaacggccggccttacggacgggtccctgactccgtcttcgtacgtcgactacgaagtcgtacgaacgaaccgccggtcctcccgtcgaccgtctcggtcgggacctcgacggtctaggactagtcggaggtcgtagttaactttaattacgttcgacgttaagttacccgaagtacgggaactacaaactaacgtaactcttacgttacgtcgggacgtaacggactacgtaccgtacgaaccgtactaacgccgacgacccggtagtccctaccgcccgttagcctcgtcccgttacccg

SEQ ID NO: 176081 - DNA, 781 bp, Homo sapiens
  misc_feature: GYAE6OF01AX7N2.33.34.D01.1.454.CMB.1.raw
  modified_base (241)..(241): a, c, t, g, unknown or other
  misc_feature (241)..(241): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcgagggcacgagggtcctgggcccagcctgccctgacctcacgccctccctccgtccgtccgggtctccgtggacagtccagtccaccatcctcctgcacgtcggaaccngcagtgactagttgggtagttactaccgaccgttcgtcctccgtacggtaaccaaaccaaccacccgacggaccaccgaccgtaccccccaaaactaccgtaactttaacttttacgtacggtacggtacctaaccgtaacggcccggtacccctaccgggtaccgggttccccgtacgaccgttccggtcctttccgtcgttcgtaccttaacccgtaagttctaccgtaaaccaacccgtacccggtacccctcccggtaccggtaccccgttcgtccggtacggggtccctacccggtacggccctagggaacgtcgtacggacggtcctaggtttaatttacgtttatcgtacgttagttcgtaacgtaaccgggtagaacctaaacgtaactacttaccgttacgttacgggtacggtaccggaacgggtaaccgtaacgtccgtaaccggtaaccgttacgtaccgtaccgaccggtacccgaccggtcccgtcccggttacccccgtagtcccgtccgttcccgttacccccg

SEQ ID NO: 176082 - DNA, 697 bp, Homo sapiens
  misc_feature: GYAE6OF01CIKOO.33.34.D01.1.454.CMB.1.raw
  modified_base (204)..(204): a, c, t, g, unknown or other
  misc_feature (204)..(204): n is a, c, g, or t
  modified_base (356)..(356): a, c, t, g, unknown or other
  misc_feature (356)..(356): n is a, c, g, or t
  modified_base (452)..(452): a, c, t, g, unknown or other
  misc_feature (452)..(452): n is a, c, g, or t
  modified_base (522)..(522): a, c, t, g, unknown or other
  misc_feature (522)..(522): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcgagggcacgagggtcctgggcccagcctcgccctgactcacgccctccctccgcgtccggtctccgtggacngtcacgtcaccactcctctgcgtcgtacggaaacctagtagtacggtacggttggacggtctaagtgtacttagtcgtcctacgtacggtaaccaaaccaacctaaccgtagaaccaaaccgtaccccctaatttactacgttactttccgngtattcgtactaccttaacgtccggtcccttaggttacgggtttcctacgtacgtccgttccttcgtcgttcggtcctaccgaacgttcgtcgacncgtacgaccgtccctaccgtactactacttcgtcgtcggtctcgacggcgtaggacgtacgtgtacggtntacttaacgttactacgtcgtacgcgtacgtcgttacgcgtacggaacggtcgaaccgttaaacgttaacggttacgggtcgtacgggaccggtacggtaaccgtaggaccgttacgtacgtacgtaccgaacgacccggtacgacccgtcccgttaccccgtggtccctaccgg

SEQ ID NO: 176083 - DNA, 903 bp, Homo sapiens
  misc_feature: GYAE6OF01EIHRW.33.34.D01.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacgagggtcctgggcccagcctgccctgactcacgccctccctcgcgtccggtctcctggacagtcagtccaccntcctcctgcacgtggaaccngcagtgactagtttggtgttactcgaccgttgtcctccgtaggtaaccaacaaccacccaggccacacgacccccaaactcacttactttagtcgacggtacaacgtaacggcccggtaccctccggacgggttcctaggacttcgtcctttaccgtcgtccggtacctaccgaaacgttcttaacgaacccgtaaccggaccccggttaccccttaccccgttacggtaaacccccgtttccgttcccggggttaccggggtaccgttaccccggtaacggtccgttaacggtaaacccgtaaggttacgggtaacggtcgtttaaggttaacgtttttaaacgtttacgtttacggtaccttaaggtttaccgtaaacgggtaccggggaaccgtaacccgaaaaaccgttaaaccgttaaaccgtttacccgttttaaccgggttttaaacccggtttcccgggggaaaccgggtaaccgggggtaaaacccctaaacggggttaccccgtaaccgggttaaccccccgtttaaacccggttaaacgggtaacccggtaaccccgggtaacccccgggtaaaaccgggttccccccgtttaccccgggtaacccccccccgtttccgggttaaccccgttaccccggtttccccgtttaacccccccg

SEQ ID NO: 176084 - DNA, 588 bp, Homo sapiens
  misc_feature: GYAE6OF01EA6MV.33.34.D01.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (380)..(380): a, c, t, g, unknown or other
  misc_feature (380)..(380): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (564)..(564): a, c, t, g, unknown or other
  misc_feature (564)..(564): n is a, c, g, or t
tcagtacacacactcacgaccggtgctcgatttagatcgtctgtgttggggtttggggggggtctcaggaggcagcgctctcaggacgtcaccaccatggcctgggctctgctcctcctccaccctcctcactcgagggcacgagggtcctgggcccagccctgccctgactcagccctccctccgcgtccggtctccgtggacngtcagtccaccntctcctgcacgtgaaccngcagtnactgttggtagttactcaccgtgttcctccgtacggtaaccaaccaaccacccgaggccaccaccgacccccaaactctactttactttatggacgtcaacgtacgccgccctacgcgggtcctgactccgtctctcgngctacgagtcagaaccacgccgtccctccgtcgccgtctcgtcggctccgagtcgtgacgngtcgagtctagtatttattntgtactacgtcgagtacggataccaacatactcttacgttgtacggacggacggtaccagtcgtacgtaccgtacaacgtcggacgaccgacgtccgttcccncccggttctacctctccgtacccg

SEQ ID NO: 176085 - DNA, 736 bp, Homo sapiens
  misc_feature: GYAE6OF01COWJR.33.34.D01.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagtacacacactcacgaccggtgctcgatttagatcgtctgtgttgggtttgggggggggtctcaggaggcagcgctctcaggacgtcaccaccatggcctgggctctgctcctcctcaccctcctcactcgagggcacagggtcctgggcccagcctgccctgactcagcctccctccgcgtccgggtctctggacngtcagtcaccatcctctgcatggaaccagcagtgactagttgggtggttatccgacgttcgtcctccgtaggtaaccaacaaccacccgagccacacgaccccaactctaatacctttangtacgtcaacgtacgccggtccctgacggggttcccngtactcgtaccttcgtcgtcggtcctaccgaattcgtacgaccaaccgtacccggccctttaccctcggtacccgttccgttacggtccgggtccctaccggcggtcctcggaacgtagttcggacggtctaggttactttaatttacgtgacttacgtttacgaggtaaccgggaaggaaccctaaaactaacctaacgttctttaccggtttacgttacccggggggacggtaaaccggggtaccaacggtacccgtaacggttaaccccgttaaccgttaacggtacccggtaaccggtaacccggaaccggtccccgttaccccgggtacccccccgttgggttaacccctccgttttccccgtttaccccccgg

SEQ ID NO: 176086 - DNA, 836 bp, Homo sapiens
  misc_feature: GYAE6OF01AB9PA.33.34.D01.1.454.CMB.1.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (341)..(341): a, c, t, g, unknown or other
  misc_feature (341)..(341): n is a, c, g, or t
tcagtacacacactcacgaccggtgctcgatttagatcgtctgtgttggggtttggggggggtctcaggaggcagcgctctcaggacgtcaccaccatggcctgggctctgctcctcctcaccctcctcactcgagggcacgacgggtcctgggccccagcctgccctgactcacgccctccctccgcgtccgggtctccgtggacagtcagtccaccntctcctgcacgtcggaaccngcagtgactgttggtagttacnccgacgtntcctccgtacggtaacccaactaacccaacccgaggaccacaccgaccccccaaacgtcaactttactttanggtacggtccacgttggacgtccggcccgtcggacggggtccctaggactccggtctttaccgtcgttcggtacctaccgtaacggttcgtacggaccaccggtacccggtcccttaccccgtccgaacccgtcgtccgttacggtccgggacccttaccgggacggtccggttaacgggtaagggtaccggttacgggtaacgggtaccttaggtttaaacgtttaccgttaccgtcggttaaccgtacgttaccgttacgggtacgttccgggaccgggtaacgggtacccggttaaaccggttaaaaccgggtttaaggggttttaccgggggtcgggtttacccgggggaaccggggttaccgggtaaacgggttacggggtaccccgttaacccggttaacggtacccggttaacccggaccgggttacccccgtaaccgggtccccggttaaccccccgggtcccccgttaggtccccgtttaccccgg

SEQ ID NO: 176087 - DNA, 718 bp, Homo sapiens
  misc_feature: GYAE6OF01BKT0C.33.34.D01.1.454.CMB.1.raw
  modified_base (249)..(249): a, c, t, g, unknown or other
  misc_feature (249)..(249): n is a, c, g, or t
  modified_base (538)..(538): a, c, t, g, unknown or other
  misc_feature (538)..(538): n is a, c, g, or t
tcagtacacacactcacgaccggtgctcgatttagatcgtctgtgttggggtttgggggggggtctcaggaggcagcgctctcaggacgtcaccaccatggcctgggctctgctcctcctcaccctcctcactcgagggcacgagggtccgtcgggcccagcctcgccctgactcacgccctccctccggcggtccgggtctccgtggacagtcacgtccacctatcctcctgccacgtacggaacccngacgagtcgacgtagttgggttagttactccgtaccgttcgttcctccgtaacgtaacccaaacaaccgaccgaggaccaaccacccgaaccccaaactctaacttacgtttagtacggtacgtactaacgtacggccggtacccgtcggtaccgggtcctagtactccgtcttcgtcgtacgtctaacgagtcctacgaaccgaccgtccggtccctaccgtgacccgtcgtcggtcggcctcggtacgcgtcgaacgtagttggacgttactaaggttatttacgtnttacgacgtttaaccgtagaaccgtaagggaccgaaactaactaacgttacttacgttaccggttaggaccggggaaggtaaccggaccgtagtaccggtaccgtaaccggtacgtaacgcccgtacggaccgtacggtcccgtccccggtacgtccgtactaccgttcccgttaccccg

SEQ ID NO: 176088 - DNA, 712 bp, Homo sapiens
  misc_feature: GYAE6OF01DY5JX.33.34.D01.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
tcagtacacacactcacgaccggtgctcgatttagatcgtctgtgttgggtttggggggggtctcaggaggcagcgctctcaggaccgtcaccaccatggcctgggctctgctcctcctcaccctcctcactcgaggcacgacgggtcctcgggcccagcctgtccctgactcacgtcctcctcgcgtccggtctcgtgacngtcacgtccacctntcctccgtgactacgtacggaaccnggactacgtgtacttaggttggtacggttatccgtacgttctccgttaccgtacggtaaccaaacctaccgacccgacgaccaaccgaccgaaccccctaaacttcgtaactttacgttacgtcggtaacggtacctaacggtaaccggcccggtacccgtacggtaaccgggtcccctgtaacgtcccgttacgtttcgcgttacggaccttacgtaacgtcacggaacctaaccgtccgtcccttaccgtcgtacccgttcggtcgttacgggtcctcggtaggtccgtaaggacgtacgtggtaacgtcgttaagttatttaacgttcgtacgtcgttacgtaacgaagtcggaacgtacaaacgtacctacgttcctaagttacggtccggacgggtaacgacgtacgtctaccggtacgtacgagacaccgcgtacgcctcccgcggtactcctcgtccgtccccg

SEQ ID NO: 176089 - DNA, 767 bp, Homo sapiens
  misc_feature: GYAE6OF01AKMK3.33.34.D01.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (393)..(393): a, c, t, g, unknown or other
  misc_feature (393)..(393): n is a, c, g, or t
tcagtacacacactcacgaccggtgctcgatttagatcgtctgtggttggggtttgggggggggtctcaggaggcagcgctctcaggacgtcaccaccatggcctgggctctgctcctcctcacctcctcactcagggcactagggtcctgggccagcctgccctgactcgacgcctccctccgcgtccgggtctccgtggacagtcagtcaccatctccngcacgtacggaaccngtcagtcgaacgtnttgggtaggttactcgtaccgtgtcctccgtacggtaaccaactaaccgacctaggccacaccgacccctaaactctattactttagcgtacgtacacgtaacggccgtaccgtacggtacgggtcctgtacgtcgtcttccncgtcggcctacgtacgtcgtacgaccaacgtccgtcctccgtacggtcccgtacgtccgtacgggtcctacggcgtacgtacgtacgtaacggtcggtaacgtcgttaacgttaactttacgtttacgtacgtacgttacggttacaacggtaacgggaacgtaaccaaaccgtacgtccttaaccgttaccgttacggttacccggggaacgggtaaccgggtaaaccggtaacgaccgggtttaccggaaaacccgtttacgggtaacccccgtggtaaccccggtaaccccgggtaccggttacccccggtaaccccggttaccccccggtttcccggaacccgttccccggttaccccgtttcccccggg

SEQ ID NO: 176090 - DNA, 991 bp, Homo sapiens
  misc_feature: GYAE6OF01D1RBK.33.34.D01.1.454.CMB.1.raw
tcagtacacacactcacgaccggtgctcgatttagatcgtctgtggttggggtttgggggggggtctcaggaggcagcgctctcaggacgtcaccaccatggcctgggctctgctcctcctcaccctcctcactcgagggcacgagggtcctcggggcccagcctcgccctgacctcacgcccctcccgtccggccggttcccgggtcctccgtaggactaggtccacgtaccaacctacttccctccgtcgaccgtaacgtacgggaaacccacggccgtaaggtacgtaacgtaggttttcgggttacggtttacgtcccgttaaccgggttcgttacccgttacccgtaaccgggttaaacccaaaacctaaaccccgaaccccggacggaccctaaaccccgaacccccgtaaaccccccctaaaacttaccttaaacttttaaacccgttttaaggtaacgggttaaccgggtaaccctaaacccgggttaaaccggggtcccccgggtaccccggttaccggggtaccccgggggttacccccttaggttaacccggttcccggttcctttccggttaccggtaccggttacctaacccgtaacgtttaccgaccgaaaccccgtaacggtaccccgtccccgttcccggtacggttaccccgttcggttccgggtacgggtaccctaccgggccggtaccgtaacgggtacgttacggtaacgggtaccggttcgttaacgtttaagttttacgttacgttacgtttacggttaacggttacttacgggacctaacggttacgtaccggttaacgggttcggtttacgggggtacggtccgggggaacggtacgggacctacgggtcccgttacggtaacccggttacggtaccgggtaccgaccggtaacccgggtccgtaccccgggttccccggttacccggtaccgttaccgtacccctttccggttccccctaccccgg

SEQ ID NO: 176091 - DNA, 509 bp, Homo sapiens
  misc_feature: GYAE6OF02HBPFL.33.34.D01.1.454.CMB.1.raw
  modified_base (369)..(369): a, c, t, g, unknown or other
  misc_feature (369)..(369): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagtacacacactcacgaccggtgctcgatttagatcgtctgtgttgggtttgggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacattggtgttatcaccgtgtctcctggtaccaacaacaccaggcacagcccccaaatcatacttatgagtcactaagcggccctcaggggtccctgatcgcttctctggctcaagtctgacaacacggcctcccngaccgtctctgggctccaggctgacgatgagctgattattattgctagttcatacggagcaacanaatctnttatcggacggaggaccagctagaccgtctaagtcagcccaaggcctcggccccctggtccactctccg

SEQ ID NO: 176092 - DNA, 523 bp, Homo sapiens
  misc_feature: GYAE6OF02HUJXH.33.34.D01.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccngcagtgacattggtggttatcaccgtgtctcctgtaccaacaacaccaggcacacgcccccaaatcatactttangaggtcactaagccggccctgacgggtccctgactcgcttctctggctccaagtctagaacaacgacgcctccctgacccgtctcgtggctccgaggctgacgatgagctgtattattattgctagttcagtacggagacaaacaacatctacttattcggacggaggacagctacgaccgtctaagtcacgcccaagctcgccccttggcacgtctccg

SEQ ID NO: 176093 - DNA, 620 bp, Homo sapiens
  misc_feature: GYAE6OF02I7N3R.33.34.D01.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctctgcactggaaccngcagtgactattggtgttancaccgtgtctcctggtaccaacaacaccagcacacgccccaatcatacttangagtcactaagccgcctcgacgggtcctgactcgtcttctcgtcggcctaccaagtctacgaaccaaccgaccggtccctcccgtacggtacccgttctccgtcggggtccctccggaggtctaggacgtagtcggaggtcttaggtaatttagtttatcgacgttacgttacgacgtacgggacgtaacaaactaactaattccgttacgtttacgttccgggacggtaacggaccaacggtctacggtaacccgttcgtaagtccgaacgtacccgaaggtccctaccgtccccgttacggtcctaccgtccttacccg

SEQ ID NO: 176094 - DNA, 556 bp, Homo sapiens
  misc_feature: GYAE6OF02GMF6Y.33.34.D01.1.454.CMB.1.raw
tcagtacacacactcacgaccggtgctcgatttagatcgtctgtgttgggtttgggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacagtttggtggttatccgaccgttgtcctcctggtaaccaacaaccacccaggccacacgcccccaaactcaatacttatgagtcactaagccgccctcgacggggtccctgatcgcttctctgctaccaagtctagacaacgaccgcctccctgacccgtctcgtgggcctccgaggcctgacgagtgacggtctagtatttagttatgactagttcaagtacggacgacaaacaacattcttagttagtcggcgaagaccagctacgaccgtactaagtccacgaccgagtcctccggccccgtgtaccacgttctcccg

SEQ ID NO: 176095 - DNA, 585 bp, Homo sapiens
  misc_feature: GYAE6OF02HDZIP.33.34.D01.1.454.CMB.1.raw
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacattggtgttancaccgtgtctcctggtaccaacaacaccagcacacgcccccaaatcatacttangagtcactaagccggccctcgacggggtccctgactccgcttctctggctacaagtctagacaacaccgccctccctgacccgtctcgtcggcctccgaggctggacgtagtggacggtctgtatttattattcgactagttcagtacgggagacaacaactaattctacgttaacgttccgggacggacgggaccaagtccgtacgacccgttactaacgtccgaacgacccgaaggtccctaccggccccccgttcggtaccctaccgttcccgttacccgg

SEQ ID NO: 176096 - DNA, 732 bp, Homo sapiens
  misc_feature: GYAE6OF02GN4X3.33.34.D01.1.454.CMB.1.raw
  modified_base (326)..(326): a, c, t, g, unknown or other
  misc_feature (326)..(326): n is a, c, g, or t
  modified_base (460)..(460): a, c, t, g, unknown or other
  misc_feature (460)..(460): n is a, c, g, or t
tcagtacacacactcacgaccggtgctcgatttagatcgtctgtgttgggtttggggggggtctcgaggaggcagcgctctcaggacgtcaccgaccatggcctcgggctctcgctcctcctcaccctcctcacctcagggcacagggtcctcgggcccagcctgccctgactcagcctcctccgcgtccgggtctccgtggacgagtcagtcaccatcctcctgcacgtggaaccagccagtgactagttgggtggttactccgaccggttgtcctccgtggtaaccaaacaaccaccaggcacacgacccccaatcatacttangagtcactaagccgccctgacgggtccctgactcgtcttctcgtggcctaccagtcgtacgacaacgccggccctcccgtacgtacccgtctacgtcgggtcctccgaggtccgtagacgtagttaggacggtntaggtactttaagttacgttcgtacgttacgtttacaacggtttaaccgggacggtaaccctaaaacgtaaaaccgttaactttcccgtttaccgtttaaggttacccggggaccggggttaaacgggaacccgtaaaggttcccgttaccggttaaccccggttaacccgttaaaccgggttcccaacccggtaaccccggtaaccggtccgttacccccgggtcccccccgttaaggttccccgtaacccgttcccgttttccccccggg

SEQ ID NO: 176097 - DNA, 556 bp, Homo sapiens
  misc_feature: GYAE6OF02FQN5M.33.34.D01.1.454.CMB.1.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (472)..(472): a, c, t, g, unknown or other
  misc_feature (472)..(472): n is a, c, g, or t
tcagtacacacactcacgaccggtgctcgatttagatcgtctgtgtttgggtttggggttctcaggaggcagcgctctcaggacgtcaccaccatggcctgggctctgctcctcctcaccctcctcactcaggcacaggtcctggcccagcctgccctgactcagcctccctccgcgtccggtctcctggacagtcagtcaccatctcctgccactggaacccagcagtgacattggtggttatcaccgttgtctcctggtacccacacaccccaggcacacgccccccaaactcatacttatgagtcactaagcggccctnacgggtcccngatcgcttcnctggctccaagtctgaccaacaccggcctccctgacccgtctcctgggcctccacggtctgaccgatcgaggtctgtaattatttattgcagctcgtatgccaggcgacaaacgtaagttttaacgggtnttacgggcggtacgggaccaaggtcgaaccgttcctaacgtccaacggcccgaaggcctcgcccccgttggtccaccttctccg

SEQ ID NO: 176098 - DNA, 607 bp, Homo sapiens
  misc_feature: GYAE6OF02IURPV.33.34.D01.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccngcagtgacattggtgttancaccgtntctccgtgtaccaacaaccaccaggccacacgacccccaaatcacttactttatgacggtcaacgtaacgccggccctacgacggggttccctgatccgtacttctcgtggcctacgaagtctagacaacaccggtccctcccgtcgaccgtcctcgtcgggcctaccgacggctcgacgtatggacgctagtattattactgactagttcacgtacggacgacaaaccgaataacttcttacgttacgttccgggacggtaacggaaccgaagtcgtacgtacccgtaccttaagtccaacgtaccccgaaggtccctaccgtccccgtcggttacctaccgtcttaccccg

SEQ ID NO: 176099 - DNA, 606 bp, Homo sapiens
  misc_feature: GYAE6OF02H8RS1.33.34.D01.1.454.CMB.1.raw
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcacatctcctgcactggaaccagcagtgacattggtgttatcaccgtgtctctggtaacaacaacacccaggcacacgaccccaaactcatactttangagtcactaagcggccctagacggggtccctgactcgcttctcgtggctcaagtctacgacaacgcgacctccctgacccgtctccgtcggctccgaggctgacgntgacgtctgtatttattagttgactagtttcagtacgggagtaccaaacgtaactaaattccttactttagttccgggacggtaacgggtaacccaagggtcctacggtaccccgttacgtaaacggttccgaaccgtacccgaagggtcccgttaccgaccccccgttaggtacccgttaccttcccgtttcccgg

SEQ ID NO: 176100 - DNA, 537 bp, Homo sapiens
  misc_feature: GYAE6OF02G7BGD.33.34.D01.1.454.CMB.1.raw
  modified_base (301)..(301): a, c, t, g, unknown or other
  misc_feature (301)..(301): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgtgtccgggtctcctggacagtcagtcaccatctcctgcactggaaccagcagtgacattggtgttatcaccgtgtctcctgtaccaacaacacccaggcacacgccccaaatcatacttangagtcactaagcggcctcgacggggtcctgatccgcttctctggctcagtctgacaacacggccctcctcgtacccgtctcgtcgggcctccgaggctgacgagtgaggctgtatttattattcgactagttcagtacggagacaacaacacttctacttacgttcggacggacggaccagctacgaccgtctaagtcacgccgaaggcctccgccccgtgtcctactccgtcccg

SEQ ID NO: 176101 - DNA, 609 bp, Homo sapiens
  misc_feature: GYAE6OF02GM281.33.34.D01.1.454.CMB.1.raw
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacagttggtggttatcaccgtgtcctcctaggtaccaacaacacccaggcacacgacccccaaatcaacttacttatgaggtcaacgtaagccgcctcgacgggtcctgactcgcttctctggcctaccaagtctacgaacaaaccgaccggtccctcccgtacgaccgttcctcgtcgggcctaccgaggctgacgatggacggtctagtatttattattgctagttcagtacggagacaaactaacgtaattctacttacgtcgggacggaacgggaaccaagtccgtacgacccgttacgtaaacgtccgaaccgacccgaacggtcccgtacccggtacccccgtggtaccttaccgttccgttaccccgg

SEQ ID NO: 176102 - DNA, 621 bp, Homo sapiens
  misc_feature: GYAE6OF02HBQGI.33.34.D01.1.454.CMB.1.raw
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (394)..(394): a, c, t, g, unknown or other
  misc_feature (394)..(394): n is a, c, g, or t
  modified_base (474)..(474): a, c, t, g, unknown or other
  misc_feature (474)..(474): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccgccatctcctgcactggaaccagccgtgacgttggngttataagtntcgtcctcctggtaccaacacgcaccaggcaaacgcccccaaatcttagtatttatagaggtcactgagccgccctgacgggtccctgactcgtcttctctggctaccagtctcgacaacgaccggcctccctcgaccnctctcgtcgggcctccgacggtctaggagggatggacggcttagtaactttacttacgtgctagccttcgtatcggacgnggaccggactaaacgttaaggtttaacgggtcggttacgggaacgggtacggaaccgtacggccggtaacccgttacggtaacgtccgaaccgacccgtaaggcccgtccggtacccccgttcggtacccgtccttcccgttccccg

SEQ ID NO: 176103 - DNA, 721 bp, Homo sapiens
  misc_feature: GYAE6OF02HGK6U.33.34.D01.1.454.CMB.1.raw
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
tcagtacacacactcacgaccggtgctcgatttagatcgtctgtgttgggtttggggggggtctcaggaggcagcgctctcaggacgtcaccaccatggcctgggctctgctcctcctcaccctcctcactcaggcacagggtcctgggcccagcctgccctgactcacgccctccctccgcgtccgggtctcctggacagtcagtcacntctcctgcacgtggaaccagcaagtcgacttagtttggtagttacncgtaccgtgtctcctaggtaccaactaaccaccacgcacacgaccccaaactcacttacttatcgagtcactaacgccgcctcgacgggtcctgacgtcgtcttcgtcgtcggtcctacgtaacgtctacgacaaccgtccggtcccttccgtacgacccgttctccggtacggtccctaccgtacggtcgtacgacggacgttagtacggtaccgttaggttaacttttaagttacgtttacgtacgttaccgtttacgtaacggtaccggtacgaacctaaaccgtaaactaacgtttccttacgtttaacgttaccggggacggtaaccggtaaacccgtacggtaccgtaccgggtaaccgttaacccggttaacgtaccggtaaaccgacccggttaaacgtcccggttaccccgtacccccggttcggtacccgttacccgttacccggtttcccccgg

SEQ ID NO: 176104 - DNA, 616 bp, Homo sapiens
  misc_feature: GYAE6OF02G0TCG.33.34.D01.1.454.CMB.1.raw
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
  modified_base (443)..(443): a, c, t, g, unknown or other
  misc_feature (443)..(443): n is a, c, g, or t
tcagtacacacactcacgaccggtgctcgatttagatcgtctgtgttgggtttgggggggtctcaggaggcagcgctctcaggacgtcaccaccatggcctgggctctgctcctcctcaccctcctcactcaggcacagggtcctgggcccagcctgccctgactcagcctccctccgcgtccgggtctcctggacagtcagtcaccntcctcctgccacgtggaacccagcagtcgacctagtttgggtgttancctaccgtgtcctccgtggtaccaacaacacccagcacacgcccccaaactcatacttangacgtcactaagccgccctgacgggtccctgactcgtcttctctcgctcagtctgaccaacncgccctcctcgacccgtctcgtggcctccgaggtctacgacgtatcggaggtcttagtacttattnttcgacttacgttcaacgtacgggagaccaaacgactattccttacttacggttaccgggacggtaacggacccgaggttcctacggtaacccgttacgtaaacgtccaaccggtacccgtaacgtcccgttcccgtcccccgttagggtccctaccgttcccgttcccccgg

SEQ ID NO: 176105 - DNA, 697 bp, Homo sapiens
  misc_feature: GYAE6OF02G9LSS.33.34.D01.1.454.CMB.1.raw
  modified_base (187)..(187): a, c, t, g, unknown or other
  misc_feature (187)..(187): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagtacacacactcacgaccggtgctcgatttagatcgtctgtgttgggtttgggggggtctcaggaggcagcgctctcaggacgtcaccaccatggcctgggctctgctcctcctcaccctcctcactcaggcacagggtcctgggcccagcctgccctgactcagcctccctcgcgtccggtcncctggacngtcagtcaccntctcctgcactggaaccagcagtgactagttggtggttaatcaccgtgtactcctggtaccaacaacaccaggacaccgacgacccccaaactccaattactttactgtaacgtcaacgtaacgccgggtccctacgacgggggtccctgaaccgttcgtccctttcgtacgtcgggaccttaccgaacgttccgtacggaacctaaacgaacccgggtccttccccggtacgtacccgttcgtaccgttcggggaccttcccgtaagggtccctaggtaacgtagtacgggtaccggtacgttacgtaagtttacgtttaacgttgtacgttagttcaacggtacggtaaggacctaacgtaactacgttctacgtttacgtacggtcggaacggtaacccgtagaccgttcgtaacccggttaccgaaggtccgtacgcccgtaagcccgttaacggccccgtacggttaccctacgtccgttacccgg

SEQ ID NO: 176106 - DNA, 701 bp, Homo sapiens
  misc_feature: GYAE6OF02FV3DJ.33.34.D01.1.454.CMB.1.raw
  modified_base (215)..(215): a, c, t, g, unknown or other
  misc_feature (215)..(215): n is a, c, g, or t
tcagtacacacactcacgaccggtgctcgatttagatcgtctgtgttggggtttggggggggtctcaggaggcagcgctctcaggacgtcaccaccatggcctgggctctgctcctcctcaccctcctcactcagggcacgagggtcctgggcccagcctgaccctgactcagccctccctcgcgtccgggtctccgtggacacgtcagtcaccntcctctgcactcggaaccagcagtgactatttgggtgttaactccaccgtgtcctccgtcgtaaccaacaacctacccgacggccaccgtaaccgacccccaaacgtactacttactttagtagtacgtacaacgtaacggccggtccctacggacggggttcccgtagtacgttaccgtccttttctccgtaggtccttaccgtaacgtcgtaacgaacctaaccgacccggtccctacccgtacgtacccgtcgtcgtccgggacctccgacgtcgtcgagtgtcgggactacttaggtaactttaagttacgttcgtacgttcgttacgtacgttacgggaactaccgaaaacaccttaacgttctttacgtttaacgtacgggtacggaacgtaaccgacgcgttaccggaccgttacggacctacggacgtaccgtacggcccgttccgtaaccccggttgtcctaccgttccgttccccg

SEQ ID NO: 176107 - DNA, 533 bp, Homo sapiens
  misc_feature: GYAE6OF01B67CC.2.74.G08.1.454.CMB.1.raw
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (397)..(397): a, c, t, g, unknown or other
  misc_feature (397)..(397): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagagccaccctctcctgcagggccagtcagagtgttagcagcaacttagcctggtaccagcaagaaacctggccaggctcccaggcctcctnatctatggtncatccaacagggccactggtactcccagccaggttcaggtggcaggtgggtctgggatagagttcactctcaccatcagcagcctgcagtctagaagtnttttgacttaagttttattactgtcagactaagttaataaatacgtggtccctccggtaggtaccgttcggaccgaagggtaccgaaaggtaggaaacgtacgaaagacgtggtagctcgacacatctgtcttacg

SEQ ID NO: 176108 - DNA, 502 bp, Homo sapiens
  misc_feature: GYAE6OF01BPUXC.2.74.G08.1.454.CMB.1.raw
  modified_base (303)..(303): a, c, t, g, unknown or other
  misc_feature (303)..(303): n is a, c, g, or t
  modified_base (488)..(488): a, c, t, g, unknown or other
  misc_feature (488)..(488): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaacngggccacgtggtactcccagccagggttcagtggcaggtgggtctgggataggagttcactctcaccatcagcagcctgcagtctgaagtattttgctagtttattactgtcagctagtataatactggtcctcggtgtacgttcggccaagggaccaaggtaggaatcgaaacgacgtgtggcngcacatctgtcttc

SEQ ID NO: 176109 - DNA, 565 bp, Homo sapiens
  misc_feature: GYAE6OF01CD1WF.2.74.G08.1.454.CMB.1.raw
  modified_base (197)..(197): a, c, t, g, unknown or other
  misc_feature (197)..(197): n is a, c, g, or t
  modified_base (418)..(418): a, c, t, g, unknown or other
  misc_feature (418)..(418): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgtagcagcaacttgcctggaccagcagaacctggcaggctcccaggcctcctcatctatggtgcatccaaacgagggccaacgtggtaactcccaagcccagggtttccaaggttggacaggtgggtctggggaataggtagttcaacgttctaccaacctatcaggcacggcctgcagtctagaaagtnttttgacttagtttattactgtacagtctaagttaataaagtaacctggtcctaccggttaggaccttcgggaccgtaagggaaccgtaaagggttagaaacgtacaaacgaacgttggtagctagaccaaccattctggtcttacc

SEQ ID NO: 176110 - DNA, 541 bp, Homo sapiens
  misc_feature: GYAE6OF01BK45J.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtgcatccaacgagggcccacgtggtactcccagcctaggttcagtggcaggtggtctgggatagagttcactctcaccatcagcacgcctgctagtctgaagtattttgacttaatttattactgtcagtactagtaataataagtaggtacctaaaggtacgttacggaccgaagggaccgagggtagaaagtacgaaacggtaacgtaggtcggcgtaggacctaccgtatccttcgttcttctaccg

SEQ ID NO: 176111 - DNA, 525 bp, Homo sapiens
  misc_feature: GYAE6OF01C82G4.2.74.G08.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgtagcagcaacttagcctggtaccagcagaacctggccaggctcccaggcctcctcatctagtggtncatccaacgaggccatggtactcccagcctaggtcagtggcaggtggtctgggatagagttcactctacaccatcagcagcctgctagtctagaagtntttgcttagtttatacgtgtcagtctaagtataatacgtcggtcctcgtggtaccgttcggaccgtaagggtaccgaaggtacggaaactacgaaacgagtggacggactcgacaccgtatcctgttctac

SEQ ID NO: 176112 - DNA, 523 bp, Homo sapiens
  misc_feature: GYAE6OF01BGDQN.2.74.G08.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaacctggccaggcctcccaggcctcctcatctatggtgcatccaacgngggccacgtggtactcccagccaggttcagtggcaggtgggtctgggataggagttcactctcacatcagcagcctgcagtctagaagtatttgacttagtttattactgtcagtctaagtataatacgtcggtccttccgtggtacgttcggaccgaagggaccgtaagggtaggaaacgtacgaaacgactggtcgctacgacacatctgtcttacg

SEQ ID NO: 176113 - DNA, 476 bp, Homo sapiens
  misc_feature: GYAE6OF01BVOQ7.2.74.G08.1.454.CMB.1.raw
  modified_base (196)..(196): a, c, t, g, unknown or other
  misc_feature (196)..(196): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaacagggccactggtactcccagccaggttcagtggcagtggtctgggatagagttcactctcaccatcagcagcctgcagtctgaagtatttgctagtttatactgtcagcagtataatactgctcgtgacgtcgcaggacaggtgaagtcaagactgngntcgcacatctgtctc

SEQ ID NO: 176114 - DNA, 558 bp, Homo sapiens
  misc_feature: GYAE6OF01BQ7OZ.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcggcaacttagcctggtaccagcagaagcctggccagactcccaggctccttatccatggtgcatccaccagggccactggtactcccagcccaggttcaggtggcagtgggtctgggacagagttcactctcaccatcagcagcctgcagtctagaagtattttgactagtttattactgtcagtctagtataattaacgtggtacccgtggtaccgtttcggaccgtaagggacccgtaaagggtacggaaactacgaaaaccggaacgttaggtacggcgttacgcctaacccgtacgttctagttcctttacacgttcccg

SEQ ID NO: 176115 - DNA, 561 bp, Homo sapiens
  misc_feature: GYAE6OF01D34IU.2.74.G08.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcagcaacttgcctggtaccagcagaacctggccaggcctcccaggcctcctnatctatggtgcatcccaagcgggccacgtggtactcccagccctaggttcaggtgcaggtggtctgggatagagttcactctacacatcagcagcctgcagtctagaagtatttgacttagtttactactgtcagtctaagttataactacgtggtacccttacggtggtaccggttcggaccgtaaaggggaccgtaaagggtacggtaaaacgtccgtaaaaggtacgttcgggtacggtaccttacggaccaaccgtattcgttcgttcttaccg

SEQ ID NO: 176116 - DNA, 699 bp, Homo sapiens
  misc_feature: GYAE6OF01BH5HH.2.74.G08.1.454.CMB.1.raw
  modified_base (196)..(196): a, c, t, g, unknown or other
  misc_feature (196)..(196): n is a, c, g, or t
  modified_base (569)..(569): a, c, t, g, unknown or other
  misc_feature (569)..(569): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttcgacgtcgttacgacagacgaacgtaacgtcgaccgacggtccctaccggacggtccctcctactacttacgttaggttcgggtcactacctaacccgaacgggaccgggaccctacggtttacggtaccctaccccgacgtacccggttacggttacgaggggtcgacggttacggggttcgggttcggtagggtaatacggttacggttacctaacctcgtaacccaacctacgtaccgacggtaccaccggttccgttacggacgttacgttacgtaaagggtaacgtttttgtttacgaacgttttaagtttttactacggttntaccgagtagtaagttaatttaaacgtacgttcggtaccgttcgggtacggttccgtaccgaacgggaacggaacgtagggtaacaactaacgaacgtgtagcgtactacgacactacgttcgtgttacc

SEQ ID NO: 176117 - DNA, 605 bp, Homo sapiens
  misc_feature: GYAE6OF01DXJFO.2.74.G08.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagcccaccctgtctgtgtctccgaaggggaaagcgcccaccctctcctgcagggccagtcagagtgtagcagctaacttagcctggtaccagacaagaaacctggccaggcctccgaggtcctcctnatctagtggtcnctactccaaacgcgggccctaagtcggtaactccccgagtcccgaggtttcaggtcggctaggggtggtcgtgggtaattaggtacgtttccacgttcctaccgacctagttccgacgcgtacgcctgacgtagtctaaggtaagttattttcgacttaagttttacttacgtgtacagtactaagtaattaaactacgtcggtccgttcggtaggtaccgttcggaaccggtaaaggtaccgtaaaggtagaaacgtacgaaacgtagtggagctacgcctacgattcgtgtcttacg

SEQ ID NO: 176118 - DNA, 559 bp, Homo sapiens
  misc_feature: GYAE6OF01B613M.2.74.G08.1.454.CMB.1.raw
  modified_base (402)..(402): a, c, t, g, unknown or other
  misc_feature (402)..(402): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaactagcctggtaccagcagaaacctggccaggcctcccgaggctcctcatctatggtgcactccaacgagggccctacgtggtactcccgagcctaggttcaggtggcaggtgggtctgggatagagttcactctaccacatcagcagcctgcagtctagaatntttgacttagtttactacgtgtacagtactaagttaataaagtaccgtggtaccctacggttaggtacccgttacggacccgaaagggtccgaaagggtagaaacgtacgaaacgtacggtggtacgcgtacggaccaccgtattcctgttcctacg

SEQ ID NO: 176119 - DNA, 530 bp, Homo sapiens
  misc_feature: GYAE6OF01ALTDK.2.74.G08.1.454.CMB.1.raw
  modified_base (196)..(196): a, c, t, g, unknown or other
  misc_feature (196)..(196): n is a, c, g, or t
  modified_base (405)..(405): a, c, t, g, unknown or other
  misc_feature (405)..(405): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttgcctggtaccagcagaacctggccaggcctcccgaggcctcctcatctagtggtgcatcccaacgcgggccacgtggtactccccgagccctaggttccaggtcggctaggtgggtctgggataggagttcactctcacatcagcagcctgcagtctagaagtntttgctagtttactactgtcagctagtactaatacgtgtcctcgtagtacggttcggaccgaagggactaaagggtacggaaactacgaaagtacgtggtacggctacgaccactatctgtctac

SEQ ID NO: 176120 - DNA, 579 bp, Homo sapiens
  misc_feature: GYAE6OF01EFYGA.2.74.G08.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtagcagcaacttgcctggtaccagcagaacctggccaggctccaggctctcatctatggtncagtccaagacgggccacgtggtactccccagccaggttcaggtggcaggtggtctgggactagngttcactctacacatcagcacgtccngcctagtctaagaagttattttgacttagtttacttacgtgtctacgctaagttaataagtaggtacggaccttaaaggtaccgttaccgggaacgtaacggggaaccgtaagggggttaaccggaaaacgttacggaaaacggtaagttcgggtaggacctcggaacctaccgaattccgtaggttccttatacccg

SEQ ID NO: 176121 - DNA, 564 bp, Homo sapiens
  misc_feature: GYAE6OF01B5SR7.2.74.G08.1.454.CMB.1.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (401)..(401): a, c, t, g, unknown or other
  misc_feature (401)..(401): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaangccacctctcctgcagggccagtcagagtgtagcagcaacttagcctggaccagcagaacctggccaggctcccaggcctcctcatctatggtncatccaaacgacgggccaacgtggtaactccccgagccctaagggttccaggtggcaggtggtcngggatagagttcactctcacatcagctagcctgcagtctagaagtntttgcttaagtttactactgtacagactaagttaataattaacgtggtacccttcggtaggtaccggttcggaaccgaaggggtaaccaaagggtaggtaaaacgaccgtaaaagtaaccgtggttacggcgtacgacctaactattcgttgttcctttaccg

SEQ ID NO: 176122 - DNA, 603 bp, Homo sapiens
  misc_feature: GYAE6OF01DIC7W.2.74.G08.1.454.CMB.1.raw
  modified_base (197)..(197): a, c, t, g, unknown or other
  misc_feature (197)..(197): n is a, c, g, or t
  modified_base (432)..(432): a, c, t, g, unknown or other
  misc_feature (432)..(432): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccacctctcctgcgagggccagtcagagtgtagcagcaacttgcctggtaccagcagaacctggccaggcctcccgaggcctcctcatctagtcggtcgacactcccgaaacgacgggccctacgttcggtactccccgagcccgtaggttccaggtcggctaggtggggtctgggataggtacgttcactctaccacatcgagtcagtcctgactagttcgagtaagttntttgactttaagtttacttactgttacagtacctaagttaattaacgtactcgggtaccttcgggtaggtaccgttacggaaccggtaaaggaaccgtaaagggtaaggaaaacttacggaaaccggtaactgggtacgactacggacctacgtattccttgtccttaccg

SEQ ID NO: 176123 - DNA, 551 bp, Homo sapiens
  misc_feature: GYAE6OF01AO8FJ.2.74.G08.1.454.CMB.1.raw
  modified_base (197)..(197): a, c, t, g, unknown or other
  misc_feature (197)..(197): n is a, c, g, or t
  modified_base (410)..(410): a, c, t, g, unknown or other
  misc_feature (410)..(410): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcaagaacctggccaggcctcccgaggcctcctcatctatggtcgcatccaacgacgggccacgtggtactcccagcctaggttcagtggcaggtcgggtcgtgggataggtacgttcacttctacacctatcgagcagcctgcagtctagtaagtntttgactagtttatacgtgtacagtactagttaactaagtacgtcggtccttcggtcggtaccggttcggaccgagggtaccgtagggtacgaaacgtacgtaaagtacgtcggtacgctacgacacgtatcgtgtcctac

SEQ ID NO: 176124 - DNA, 561 bp, Homo sapiens
  misc_feature: GYAE6OF01C8QVS.2.74.G08.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (426)..(426): a, c, t, g, unknown or other
  misc_feature (426)..(426): n is a, c, g, or t
  modified_base (551)..(551): a, c, t, g, unknown or other
  misc_feature (551)..(551): n is a, c, g, or t
tcagacgctcgacacacgaccggtgctcgatttagtagctctatcagggggaggaactgctcagttaggacccagacggaaccatggaagccccagcgcagcttctcttcctcctgaactactctggctcccagataccactggaagaaatagtgatgacgcagtctccagccaccctgtcttgtgtctccgaggggaaancgccaccctctcctgcagggccagtcagagtgttagcagcaacttgcctggtaccagcaagaaacctggacccaggcctcccgaggcctcctcatctagtggtcnccataccaacgacgggcccacgttcggtaactccccgagcccgtaggttccaggtggcaggtgggtctgggatagacgttcactctcaccatccagcacgtcctgcagttctagtaagtnttttgacttagttttactacttgtcagactaagtaacttaataacgtcggtccgtcggtggtaccgttcggaccaagggaccaagggtagaaacgtacgaaacgtagtgtaggctcgacctactntctgtctacg

SEQ ID NO: 176125 - DNA, 632 bp, Homo sapiens
  misc_feature: GYAE6OF01ACY0Y.2.74.G08.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttgcctggtaccagcagaaacctggccaggcctcccaggcctcctcatctatggtgcatccaacgngggccactggtactcccgagccaggtcagtggcagtgggtntgggatagngttcactctcaccntcagcacgtcctgcctagtctacggtaagttagttttgacgttaagttttactttacctgtactagtccgtaagttaacttaaagttaaccgttcgggtacccttccgggttcgggtaacccggtttccgggaaccgtaaaccgggggtacccgtaaaggggttaaccggaaaacgttacccggtaaaaccggtaacggtttcgggtacgggtaccgttacggtaccctaaccgtaacgtttccttggttcccgtttaacccg

SEQ ID NO: 176126 - DNA, 592 bp, Homo sapiens
  misc_feature: GYAE6OF01DJA3U.2.74.G08.1.454.CMB.1.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (378)..(378): a, c, t, g, unknown or other
  misc_feature (378)..(378): n is a, c, g, or t
  modified_base (575)..(575): a, c, t, g, unknown or other
  misc_feature (575)..(575): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaagagccaccctctcctgcagggccagtcagagtgttagcagcaacttagcctggtaccagacagaaacctggccaggcctcccaggcctcctcatctatggtgcatccaacngggccagtgtacncccagccaggttcagtggcaggtgggtctgggataggagtttcactctccaccatccganccacgcctggctagtactggtaaagttgttttagcttagttttaattacgtcgtacagactaagttaattaacgtaccgtcgggtacccttccgggttaggtaccggtttccgggaaccgaaacgggggtaacctaaagggttaacggaaacgtaaccgaaaacggtacttcgggtagtccgtaagccctaaacctnttcttgttcccttaccg

SEQ ID NO: 176127 - DNA, 683 bp, Homo sapiens
  misc_feature: GYAE6OF01C1006.2.74.G08.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtctaccgaaggggaaanagcccacctctcctgcagggccagtcagagtgtagcagcaacttagcctaggtaccagcagaaacctggccaggcctcccgaggtcctctcactctagtggtcnctactaccgaagcgggaccctagtaggtacctccccgaaggtcccgtaagggttccaaggttcggaccgtaagggttcggggttacgtaaggggaattagggtactttacaccgttactacctaaccacgttacacggacctacggccctaggtaccgtaggttacctaaggtaaacgtttattttacgggactttaagtttttaactacgttgtacaagtactaaggttaactaagtacgtcgggtaccgttaccggtaggtacccgggttacgaaccggtaaagggtaaccgaaagggttaacgaaacgttaaccgaaacgggtacgtggttacgggtacctacgtaacccgaactattccgttacgttccttaccg

SEQ ID NO: 176128 - DNA, 738 bp, Homo sapiens
  misc_feature: GYAE6OF01DHI0J.2.74.G08.1.454.CMB.1.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtcctccagccaccctgtctgtgtctaccgaggggaaanacgccaccctctcctgcagggccagtcagagtgtagcagcaacttgcctggtaccngcagaactggccaggctccagctctcatctatggtcgcatcccaacgagggccacgtggtactcccgagcctaaggttccaggtcggcgaggttcggggtcgtaggggtatagtacgttccaacgttccttacaaccctattccgaacggaccacggtaccccgttggaccgtaacggttccgttaagggtaaaagtttacgttttttcgggaactttaaacggttttttaacttaccgtttacggtttacgtaacggttaccttaaaggtttaaacttaaaaccgtttaaaaccggtttcggggtaccccgtttaccccgggttaggggtaacccggttttacccggggaacccggtaaaaccgggggaaaccccgttaaagggggtaacgtaaaacgtaaccggtaaaaccggtaacggttcgggtacgggtccgttacggtaccctaaacccgtagtttaccgtcgtttcctttaccccg

SEQ ID NO: 176129 - DNA, 604 bp, Homo sapiens
  misc_feature: GYAE6OF01DVK0B.2.74.G08.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctaggtaccagcagaaacctggccaggctcccaggctcctcatctatggtncatccaacgagggccagtggtactcccagccaggttcagtggcaggtgggtctgggatagagttcactctacacatcagcagctgcagttctagaatnttttgacttagtttacttacgtgtacagtactaagttaacttaagttaaccgtcgggtcccttaccggtacgggtaccggtttaccgggaccggtaaaacggggtaccggtaaagggtacgggaaaacgttaccggaaaaacggtaacggttcggtacgggtaccgtacggtaccctaaccctaagttccgttagtttcccgttaacccg

SEQ ID NO: 176130 - DNA, 545 bp, Homo sapiens
  misc_feature: GYAE6OF01CEI0E.2.74.G08.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttgcctggtaccagcagaaacctggccaggcctccgaggctcctnatctatggtncatccgaacagggccaagtcggtaatccccgagccaggttcagtggcagtgggtctgggatagngttcacgtctcaccatcagcagcctgcagtctgaagtntttgactagtttatactgtacagtactagtataatacgtggtccctcggttacggaccgttcgggaccgaagggaccgtaaagggtaggtaaacgtacgaaacggtaacgtggtcggtactcgtaccgacctattccttgttcgttacg

SEQ ID NO: 176131 - DNA, 726 bp, Homo sapiens
  misc_feature: GYAE6OF01C6SRZ.2.74.G08.1.454.CMB.1.raw
  modified_base (199)..(199): a, c, t, g, unknown or other
  misc_feature (199)..(199): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccacgtggagaaatagtgatgacgcagtctccagccaccctgtctgtgtctaccgaggggaaancgccaccctctccgtgccgagggccagtcagagtgtagcagcaacttagcctggtaaccagaccaacgaaaccgtcggaccctaggtcctcccgaggtcctcctacattccgtagtggtcgactacgtacccgaacggtacgggtaccctaagttacggtaacctccccgagtcccgtaggttaccaggttcggactacgggttggtctaaggggaacttaggtacgttctaaccgtcctactaacccagttccgaacgtaccgacgtcccgtagacctaaggttcctaaggtaaagtttacgttttcgaacgttttaaggtttttaacttacgtcgtttacgaacgtcgttaaaggttaacttaacgttaaccgtcgggttaccccgttaccgggttagggttacccggtttacgggaaccgtaaacggggtaaccgaaggggttaacgaaacgtaaccgtaaaacggtacgttcggtaccggtacttacgggtaacctaccgtatttaccgtgtttccttaaccg

SEQ ID NO: 176132 - DNA, 761 bp, Homo sapiens
  misc_feature: GYAE6OF01BZXFK.2.74.G08.1.454.CMB.1.raw
  modified_base (198)..(198): a, c, t, g, unknown or other
  misc_feature (198)..(198): n is a, c, g, or t
  modified_base (741)..(741): a, c, t, g, unknown or other
  misc_feature (741)..(741): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagccaccctgtctgtcgtctcgaggggaaancgcccaccctctcctgcgagggccagtcagagttgtagcagcaaacgttgcctaggtaaccagacaacgaaaccgtggacccaggcctacccgaggtcctaccctacacgttaccttaagtcgggttacgacctaacgttacccgaaaaccgtcggggaccctaacgttacgggttaacctaccccgacggtacccgtaagggtttaccgaggttacgggaccgtaggggttgggttacgtaggggaattaggtacgtttccaaccgttcctaccaaccgtacttaccgagccgtaagtcccgtacggaccttaaggttccgtaaggttaaacgtttagttttttaccgggaaccttttaaggtttttaacctttacgttacggttacgaagttaccgttaaagttaacttaaacgttaaccgtcggtaccccgttaccggttagggtaccggttaccggaaaccggtaacgggtaaccgtaaaggggtaaactaaacggtaaccgaaaaggtcgttaggacggtacgtaccgtacctaaacnctttacgttcgtacttaccg

SEQ ID NO: 176133 - DNA, 502 bp, Homo sapiens
  misc_feature: GYAE6OF01ANF1Z.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggcctcctcatctatggtgcatcccaacacgggccacgtggtactcccagccaggttcagtggcaggtgggtctgggatagagttcactctcaccatcagcagcctgcagtctgaagtatttgactagtttatactgtcagctagtataatacgtcgtcctcgtggtacgtcggacgaagggacaaggtagaacgtacaaacgagtgtggctgacactatctgtctc

SEQ ID NO: 176134 - DNA, 523 bp, Homo sapiens
  misc_feature: GYAE6OF01B1W2U.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgtagcagcaacttgcctggtaccagcagaaacctggccaggctcccaggctcctcatctatggtgcatccaacagggccactggtactcccagccaggttcagtggcaggtgggtctgggatagagttcactctcaccatcagcagcctgcagtctagaagtattttgacttagtttattacgtgtcagtcagtaataactacgtggtaccctcgtggtacgttcggaccgaagggacctaaggtaggtaaacgtacgaaacgacgtgtcggactcgacaccatctgtcgttac

SEQ ID NO: 176135 - DNA, 598 bp, Homo sapiens
  misc_feature: GYAE6OF01BZGQ1.2.74.G08.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgtagcagcaacttgcctggtaccagcagaacctggccaggcctcccaggcctcctnatctatggtgcatccaacgagggccacgtggtactcccgagccaggttcaggtggcagggttgggtctgggataggagttccactcncaccatcagcagcctgcagtctgtaagtattttgcttagtttattactgtacagtactagttaattaagttacgtcgggtacccgttcggttacgggtaccggtttaccgggaccgtaaacggggtaaccgtaaaggggtacggtaaaacgttaccgaaaacggtaacgttcgggtacgggtaccgttacggtaccctaaccgtacttaccgttcggttcctttaccg

SEQ ID NO: 176136 - DNA, 663 bp, Homo sapiens
  misc_feature: GYAE6OF01DTMJM.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcagcaacttgcctggtaccagcagaaacctggccaggcctcccgaggcctcctcatctagtggtcgcactcccgaacgacgggcccacgttcggtactccccgagcccgtagggttccaggtcggacgtagggtcggggtacgtggggtataggtacgttccactctacacctatcagcacgtcctagcagtctacggtaagttacgttttcgactttaaggttttactacgttgttaccaggtactaagttaattaaacgttacgtacggtccgttaccgggttacgggtaaccgttccgggaacccggtaaacgggtaaccgtaaacggggttaacggaaaacgttacccggaaaacggttacggttcgggttacggtccgttaaccggtacgaacccctagttttccgttccggttacctttaccg

SEQ ID NO: 176137 - DNA, 587 bp, Homo sapiens
  misc_feature: GYAE6OF01A7P0V.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttgcctggtaccagcaagaaacctggccaggcctcccgaggcctcctcatctagtggtgcactcccaacgacgggccacgtggtactcccagcctaggttcaggtggcgtaggtgggtctgggataggtacgttcactcctcacctatcagcagcctgctagtctagtaagttagttttgacttagttttacttacgttgtacagtactagttaataaacgtacgtcgggtacccgttaccggttcggtaccggttaccggaccgaacgggaaccgtaagggtaacggtaaacgtacgaaacggtacgtggtacggacctacgaccacctagtcttgttccgttacc

SEQ ID NO: 176138 - DNA, 695 bp, Homo sapiens
  misc_feature: GYAE6OF01EP3XZ.2.74.G08.1.454.CMB.1.raw
  modified_base (201)..(201): a, c, t, g, unknown or other
  misc_feature (201)..(201): n is a, c, g, or t
tcagacgctcgacacacgaccggtgctcgatttagtagctctatcgagggggaggaactgctacagttaggacccagacggaaccatggaagccccagcgcagcttctcttcctctgctactctggctccagataccactgggagaaatagtgatgacgcagtctccagcctaccctgtctgtgtctaccgaaggggaaanacgcccaccctctcctgcgacgggccagtcagagtgttagcagctaattacgcctaggtaccagcaacgaaacctggaccaggcctaccgaggtcctcctcatctagtcggtcgccaacgtcccaacgtcggggacctaacggtcggtactccccgaagcccgtagggttccaaggtcgggactagggttcggggtctaggggtaacttacggacgtttccaaccgtttctaccgaaaccctatacccgaacgtccgaacgtccgttagaccgtaacggttacgttaaggtaaacgttagttttttacggaccgtttaaggtttacttaccgtcgttactacggtctaaacgtttaactaacgttaaccgtcgggtaccttacccggttaggtaccggttaccggaccggtaagggaacccgtaaggggtaacgtaaaacgtaacgtaaacggtaacgtggtacggtcgtagacccacgtatcttgtcgttacc

SEQ ID NO: 176139 - DNA, 541 bp, Homo sapiens
  misc_feature: GYAE6OF01B6EDU.2.74.G08.1.454.CMB.1.raw
  modified_base (306)..(306): a, c, t, g, unknown or other
  misc_feature (306)..(306): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttgcctggtaccagcagaacctggccaggctcccaggcctcctcatctagtggtgcatcccaacgngggcccacgtggtactcccagccaggttcagtggcaggtgggtctgggataggagttcactctcaccatcagcagcctgcagtctagaagtattttgcttagtttacttactgtcagtctaagtataatacgtcggtcctcgtaggtaccgttcggaccgaagggtaccgaagggtacggaaacgtacgaaacgtacgtcggtacgtcgtacgcctacctagtcttgtccttacg

SEQ ID NO: 176140 - DNA, 523 bp, Homo sapiens
  misc_feature: GYAE6OF01C628F.2.74.G08.1.454.CMB.1.raw
  modified_base (280)..(280): a, c, t, g, unknown or other
  misc_feature (280)..(280): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggcncctcatctatggtgcatccaacagggccactggtactcccagccaggttcagtggcaggtgggtctgggatagagttcactctcaccatcagcngcctgcagtcgtagtaagtnttttgacttagtttatacttgtcagtcagtataataactggtccttcgtggtaccgttcggaccgtaacgggacgaaggtaggaaagtacgaaacgaacgttgtggctacgcaccattctgttcttacg

SEQ ID NO: 176141 - DNA, 651 bp, Homo sapiens
  misc_feature: GYAE6OF01C05XH.2.74.G08.1.454.CMB.1.raw
  modified_base (198)..(198): a, c, t, g, unknown or other
  misc_feature (198)..(198): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagccaccctgtctgtgtctacgaggggaaanacgcccaccctctcctgcgagggccagtcaggtgtcgttagcagacaacttcgcctggtaaccagacagaaccgtggaccaggcctaccgaggtcctctactatctagtggttcactacgtacccgaacgacgggtcccaacgttcggtacctcccgaaaggcccgtaggttaccgaggtcggacgtagggtcgggttacgtgggtaactaggtacgtttccgaacttctaccaacctagtaccagccgaacgtccttaggctacttcgtaagtaagtttagtttcgactttaagttttactagttcgtaatacggtactaaggtttaactaaacgttcgtccggttaccgtcggtacgggtaccgtcgggaacctaagggaaccgaggtaagaacgtaacgaacgtacgttggtaccgcgtagacccttaacgtatccttgttccgttaacc

SEQ ID NO: 176142 - DNA, 605 bp, Homo sapiens
  misc_feature: GYAE6OF01CAYYT.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagcagcaacttagcctggtaccagcaagaacctggccaggcctccgaggcctcctacatctagtggtcgcactccgaaacgcgggaccatggtactccccgaggcccgtaggttcaggttcggacgtagggttcgggtcgtaggggtataggtacgtttccaacgttcctaccaaccgtatcgagtcctacgtccgtgactacgttcgtaacggtaagttcgttttacgacgtttacgttttacttcgttcggttacaggtactaagttataacgtactcgggtccttacgggtcgtacggttccggacgaacgggactaagggtagaaacgtcgaaagtacgtggtcgctacggactacatcgtgttctacg

SEQ ID NO: 176143 - DNA, 562 bp, Homo sapiens
  misc_feature: GYAE6OF01BP50K.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctcccaggcctcctcatctagtggtgcatcccaacgagggcccacgtggtactccccagcctaggttcagtggctaggtgggtctgggataggagttcacttccacacctatcagtcacgtcctgctagtctaggaattgtttgacttagtttactactgtcagtctaagtaataactacgtcggtcccttaccggttggtacccgttacggaccgaacgggaccgtaaagggtacggaaacgtaccgaaacggtacgtggtacggtctacggaccactattctgttcctacg

SEQ ID NO: 176144 - DNA, 605 bp, Homo sapiens
  misc_feature: GYAE6OF01DYAV7.2.74.G08.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactgganaaatagtgatgacgcagtctccagccaccctgtctgtgtctccgaggggaaancgcccaccctctccgtgcgagggccagtcagagtgttagcagacaacttagccgtaggtaccagacaagaaacctggccaggcctacccgacggcctcctctatctagtggtcactactaccgaacgcgggccacgttggtaacctcccgagcctaggttcaggtggcaggtcgggtctagggataggtagtcactctacgactatcagccagcctgacgtaagttnaacggtaaagttnttttagactttaagttttacttactggtacagactaagtaataagtacgtcgtccgttacgggtacgtccgttacggaccgaaacgggtaccaaagggtacgtaaacgtaaccgtaaagtacgttgggacgccgtaacgcctaacctagttccgtcgttcgttaaccc

SEQ ID NO: 176145 - DNA, 696 bp, Homo sapiens
  misc_feature: GYAE6OF01DLAL9.2.74.G08.1.454.CMB.1.raw
  modified_base (310)..(310): a, c, t, g, unknown or other
  misc_feature (310)..(310): n is a, c, g, or t
  modified_base (461)..(461): a, c, t, g, unknown or other
  misc_feature (461)..(461): n is a, c, g, or t
tcagacgctcgacacacgaccggtgctcgatttagtagctctatcagggggaggaactgctcagttaggacccagacggaaccatggaagccccagcgcagcttctcttcctcctgctactctggctccagataccactggagaaatagtgatgacgcagtctccagccaccctgtctgtgtctccgaggggaagacgccaccctctcctgcgagggccagtcgagagtgttagcagacaacttagcctaggtaccagaccaacgaaaccgtggacccaggcctcccgaggtcctcctcatctagtggcncactaccgaacgtacgggcctacgttcggtactccccagccgtaggtccgaggttcggcgtagggtgggtacgtagggtaatacggtacgttccacttcgtaccaccgtatcacgtaccacggtcctagacgtagtacgtaagtaacgttnttttcggactttaaggttttactactgtacctaagtacgtaagttaattaacgtaccgtcgggttacccgttaccgggttacgggttaacccgggttcccgggtaaccgggaaaaccggggtaaccggtaaggggttaaacggaaaaccgttaaacggaaaaccgttacgggttacgggtacggtaccgttacggtaacccctaacggttacttacggttccgtttccttaaccg

SEQ ID NO: 176146 - DNA, 858 bp, Homo sapiens
  misc_feature: GYAE6OF01AWD12.2.74.G08.1.454.CMB.1.raw
  modified_base (197)..(197): a, c, t, g, unknown or other
  misc_feature (197)..(197): n is a, c, g, or t
  modified_base (324)..(324): a, c, t, g, unknown or other
  misc_feature (324)..(324): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctgggtacccagcgaagtaaaccctggccacgggcctcccagggcctcctacacgttctagtggtcacactcccaacgngggtcccacgttggtacctacccgagtccccgtaagggtttccaaggttcggaccgtagggtcggggttcgtagggggaattaggtaacgtttccaccgtttacctacctaacccgaattccgacggaccgtacggtaccccgtgggttaccaccggtttaccgtaacgggttaaacggtttaagtttttttaccgggtaacccttttaaagggttttttaaccttttaaacccggtttggtttaaaccgttaccggtaaccgttaaacggtttaaagtttaaaacccggtttaaacccggtttcccggggttaacccccgtttccggggtttaacccgggggtaaccccggttttacccggggaaaccccgggttaaacggggggaaccccggttaaaaagggggtttaaccgggaaaaaccggttacccggttaaaaacccggttaaccgggttacggtaccggggtaaccgtttaaccggaaccccgtaacccgttacggttacccttacgggttttcccccgtttaaccg

SEQ ID NO: 176147 - DNA, 651 bp, Homo sapiens
  misc_feature: GYAE6OF01DJQAC.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaangccaccctctcctgcagggcccagtcagagtgttagcagcaacgttgcctaggtaccagacaacgtaaacctcggaccaggcctcccgaggtcctcctcagtccgtagtcggtcgactacgtaccgaacgaggggtccctaacgttgggtaacctccccgaaggtcccgtaagggtttaccaggttcgggacctaagggttcgggtactaggggaactaggtacgttccaacgtctaccgaacccattccagcacgtacctgactagtctaagtaagttcttttacgattagtttagtacgtgtcagtctaagtaattaagttacgtcggtacccgttcggtacggttaccgttcgggaccgtaaacgggtaccgtaagggtacggaaacgtacgtaaaacgtacgttggtacgtcctacggtacctaaaccgttgttaccgtcgttcgtaccg

SEQ ID NO: 176148 - DNA, 649 bp, Homo sapiens
  misc_feature: GYAE6OF01DOWGA.2.74.G08.1.454.CMB.1.raw
  modified_base (622)..(622): a, c, t, g, unknown or other
  misc_feature (622)..(622): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagcccaccctgtctgtgtctcgaggggaaagacgcccaccctctcctgcacgggccagtcagagtgtagcagctaactcgcctaggtaccagacacggaaaccgtcggaccagggcctcccgacggtcctcccgtactacttctagtcgggtcacctactacccgaaccggacggggaccctaacggttcggtaacctccccgaggtaccccgtagggttaccgagggtcggtacgtaggggttcggggttacgtacggggtaatacgggtacttcaccttctaccacgtatcacgcacgcctgacgagttcgtaagtaagtctttgatttatttactacgtgtactagtactaagtaacttaacgtacgtccgggtccgttaccggtggtaccgttccgggaacgtaaaccgggacgtaaagggtagtaaacgtacgaaacgtacgtgaccggntacgcctaactcttcgtcgtcttaccg

SEQ ID NO: 176149 - DNA, 843 bp, Homo sapiens
  misc_feature: GYAE6OF01D0XPO.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaatagtgatgacgcagtctccagccaccctgtctgtgtctccgaggggaaagacgccaccctctcctgcgacgggccagtcagagtgttagcagctaacttagccgtaggtaccagaccaacgaaaccgtggacccaggcctacccgacggccttccctctactcttagtgggtcgcctactacccgaacgacgggcctaacgtcggtactccccgagtccgtaggttcaggtcggcgtagggttcgggtacgtggggtaatacggtacgtttccaacgttcctacccaaccctacgttccacggtaccgtaccggtcccgttacggacccgtacggtttaccgtaagggttaaacgtttagttttttccggaacgtttttaacggttttttaacgttaccgtttacggttacccgtaaagggttaccctaaaaggttttaaacctttaaacggtttaacccggttcccggggtttaccccgtttacccgggggtttaacggggttaacccccgggtttaccggggtaaaccccgggtaaaacgggggtaaaccccggttaaaagggggttaaaccgggtaaaaaccgttaacccgggtaaaaaccggttaacggtttcggggtaaccgggttaccggtaaccggtacccgttaaaccccgttagtttaccccggtttgttttaccccgttaaaccccg

SEQ ID NO: 176150 - DNA, 585 bp, Homo sapiens
  misc_feature: GYAE6OF01DLGPD.2.74.G08.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaanagcccaccctctcctggcaggggccagtcagtagtgttagcagacaacttgcctaggtaccagacacgaaacctggaccaggcctcccgaggctcctnactctatgggtcncatccaagacgggccctatggtactcccagtccgaggttcaggtgctaggtggtctagggatagcgttcactctcaccatccaagccagcctgaccgtagttcgtaggtaaagttgttttgacttaagtttttatacgttgtcaagtctaagtaataacgtaacgtcgggtccctcgggtacgtaccggttcgggaacgtaacgggccaaagggtagaaacgttacgaaacggtatgggacgggtctacgtaccaactacttcgtcgttcttacccg

SEQ ID NO: 176151 - DNA, 752 bp, Homo sapiens
  misc_feature: GYAE6OF01D5IX6.2.74.G08.1.454.CMB.1.raw
  modified_base (233)..(233): a, c, t, g, unknown or other
  misc_feature (233)..(233): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (517)..(517): a, c, t, g, unknown or other
  misc_feature (517)..(517): n is a, c, g, or t
  modified_base (562)..(562): a, c, t, g, unknown or other
  misc_feature (562)..(562): n is a, c, g, or t
tcagacgctcgacacacgaccggtgctcgatttagtagctctatcgagggggaggaactgctcagttaggacccagacgaaccatggaacgccccagcgcagtcttctccttcctcctgctactctcggcctcccagtactaccacgtgggaagtaaataggtgatggaccgcacgttcctaccgacgccctacccgtgtccgttggtcgttccgaccggaagggggaaaacncctcccctacccttctccgtaggccgacgggactagtacgaggtagtcggtaagctaagacctaacgttcgccgttacggacagaccaacgtaaccgtcggaccgacgccgtaccgacgtcctactcgtactgtagtcggtctaccaacgtaccggaacgaccggtacctggtacggtacctcccgaggtccgtaggttcgaggtcgtacggtaggggtcgtacggtgtagtcgtacttccgactacgtacnctagtcncgacncgtcgtacgacgtacgttanacggttatttacgttacgtaacgtttatttgtacgtgtataagtntaagtacttaacgtacggtccgtttaccggaccggttacggtaccggtacggtaaccggggaacggtttacccggaaacgttaaacgtaaaaccgggtaccgtttaaaaccgggcggtttaccgggtccggtaaacccgttacgtaaccccgttaacgttacgttccgtttaaccgtacccggtttaacc

SEQ ID NO: 176152 - DNA, 643 bp, Homo sapiens
  misc_feature: GYAE6OF01AM29R.2.74.G08.1.454.CMB.1.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
  modified_base (609)..(609): a, c, t, g, unknown or other
  misc_feature (609)..(609): n is a, c, g, or t
  modified_base (638)..(638): a, c, t, g, unknown or other
  misc_feature (638)..(638): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaancgccacctctcctgcgagggccagtcagagtgtagcagctaacttgcctggaccagcaagaaccgtggccaggcctcccgaggcctcctcactctagtggtcncctaacgtcccaagcgggaccctagtggtaacctcccgagtaccgtaggttccagggtcgcgtagggtcgggtacgtacgggtattacggtacgttacccaccgtttcctacccgacctacgttacccgacgacccgtaggtccccttacggcttaacggttacgttaagtaaacgtttgttttacgacgtttaagttttacttcgtacggtactagtacctaagtaactaacgtacgtccgtaccgttacggtacggtaccgtacggaacggtacggtaccgtaaaggtaccgaagtaccgaaaggttcngggtcacgtcgacctacgacttctcgttntaccg

SEQ ID NO: 176153 - DNA, 756 bp, Homo sapiens
  misc_feature: GYAE6OF01C1ZB1.2.74.G08.1.454.CMB.1.raw
  modified_base (203)..(203): a, c, t, g, unknown or other
  misc_feature (203)..(203): n is a, c, g, or t
tcagacgctcgacacacgaccggtgctcgatttagtagctctatcaggggggaggaactgctcagttaggacccagacggaaccatggaagccccagcgcagcttctcttcctcctgcctactctggctcccagactaccactggagaaatagtgatgacgcagtctccagcccaccctgtctgtcgtctaccgaggggaaanacgcccaccctctcctgcgagggccagtcagagtgtagcagctaactcgcctggaccagacaacgaaccgtcggccgaggcctcccgaggcctcctcattccgtagtcggtcgactactaccgaacgacgggccctagttcggtactcccgagtccgtaggttccgaggttcggacgtagggttcgggtcgtaggggaattacggtacgttcctaaccttccgtaaccctaaaccctagtccgaaccggtcctacggtaccctacggaccgtacggttacgttaaggttaaggttttacgttttacgtaacgtttttaagtttttaacgtaccggtttacggtaacgtaacgttaaccgtttaagttaaacttaaacgttaaccgtccggggttacccgttaccggggtttaacgggtaccccgggtttacgggaaacccgggtaaaccggggtaaccggtaaaacgggtacgtaaaaccggtaaccggtaaacgtaaccgggttggtacccggtctaacgaccctaacgttacgttcttagttccttaaccg

SEQ ID NO: 176154 - DNA, 634 bp, Homo sapiens
  misc_feature: GYAE6OF01CWMNU.2.74.G08.1.454.CMB.1.raw
  modified_base (200)..(200): a, c, t, g, unknown or other
  misc_feature (200)..(200): n is a, c, g, or t
  modified_base (318)..(318): a, c, t, g, unknown or other
  misc_feature (318)..(318): n is a, c, g, or t
  modified_base (442)..(442): a, c, t, g, unknown or other
  misc_feature (442)..(442): n is a, c, g, or t
  modified_base (470)..(470): a, c, t, g, unknown or other
  misc_feature (470)..(470): n is a, c, g, or t
tcagacgctcgacacacgaccggtgctcgatttagtagctctatcagggggaggaactgctcagttaggacccagacggaaccatggaagccccagcgcagcttctcttcctcctgctactctggcctcccagataccactggaagaaatagtgatgacgcagtctccagccaccctgtctgtgtcctccgaggggaaanacgcccaccctctccgtgcgagggcccaggtcaagagtgttagcagcaacttgccgtggtaccagacaacgaaacccgtggaccctaggcctcccgaggcctcctcatcctagtggcncactacccaacgcgggaccacgttggtactcccgacgaccgtaggttcaggtcggacgtagggtggggtcgtaggggataaggtcgttaccgactctaccacctacgtcaacggtcacggtccnggaccgtagtttcgtaaggtaaagtttnttttacgacttaagttttacgttactggtaccaggtactaagtaagtaacttacggtcggtccgttacgggttcgtaccggtcggaaaccggtaacggtaacgtagggtaagaaaccgtacgaaacggtcgtggtcgacgtcacctactgttactcgttctacc

SEQ ID NO: 176155 - DNA, 678 bp, Homo sapiens
  misc_feature: GYAE6OF01D6FRY.2.74.G08.1.454.CMB.1.raw
  modified_base (199)..(199): a, c, t, g, unknown or other
  misc_feature (199)..(199): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtctaccgaaggggaancgcccaccctctccgtgcgacgggccagtcagtagtgtacgcagctaacgttacgcctaggtaccagacaacggtaaacctcggaccaggcctccgacgcctcctcatactagtggtcgacacgtaccgaacggcggtacctagttacgtacacccgtagtaccgtaggttacgaggtcggtacgtaggtcgggtacggtagggtacgttagtaccgttactaccgttctaccgtacctactacgacgccgtaccgtcgtagaccgttagtacgttaagtacgttttagtttacgtagttttaagtttacgttacgttacgtactaagtaagttaacgtaaattaaccggtacggtccggttacccgttcgggacgggttacccggtacgggaaccgtaacggggtaacgtaagggtaaactaacgtaaccggaagttacgtggacgtacacgtactactacgttcttactgttacccg

SEQ ID NO: 176156 - DNA, 640 bp, Homo sapiens
  misc_feature: GYAE6OF01AMVSA.2.74.G08.1.454.CMB.1.raw
  modified_base (195)..(195): a, c, t, g, unknown or other
  misc_feature (195)..(195): n is a, c, g, or t
  modified_base (316)..(316): a, c, t, g, unknown or other
  misc_feature (316)..(316): n is a, c, g, or t
tcagacgctcgacacacgaccggtgctcgatttagtagctctatcagggggaggaactgctcagttaggacccagacggaaccatggaacgccccagcgcagcttctcttcctcctgctactctggctcccagataccactggagaaatagtgatgacgcagtctccagccacctgtctgtgtctcgaggggaancgccacctctcctgcgagggccagtcagagttgtacgcagactaaacgtttgaccttacggtaccagaccaacgtaaacctggaccacggcctcccgaggcctcctcactctagtcggacnctactaccgaacgcgggacctacgtggtacctccgacgccgtaggttcacggtcgactagggtcggtcgtagggtaactgtacgttacactctaccaccgtactacgacgctacgtccgtcgacgtagtacgtaggtaagttacgtttcgtacgttagttttactacgttggtctagtactacggttaataacgttacgtccggtacttaccgggtcgtaaccggtacgaaccggaacgggtacgtaaagggtaccgaaaacggtacgtaaaccggttggtacggtacgccgtacgacctacgtactcgtaacgttctaacccg

SEQ ID NO: 176157 - DNA, 873 bp, Homo sapiens
  misc_feature: GYAE6OF01CNUDY.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcaggtctccagccaccctgtctgtgtctccgaggggaanagcccaccctctcctggcacggggccagtcgagagtgttagcagctaacgttgccgtaggtaccagacaacggaaaccgtcggaccgaacggtccctaccccgaacgggtccttcccctaccgtacttaccgttaagttcggggttacacgtaaccgttaaccccgaaacggtaccgggggacccctaacggttacgggttaaccctaccccgacggtacccggtaacgggtttccggtaagggtaccggggtacggttaacggggttcggggggttaccggttaggggtaaacgttaacgggttaccgtttaccgtaaccgttacccttaccggaacccttaaagtccaacgggtaccctaacggtccccgttcggtaacggttacgtttaccggtaaagttaaaagggttttcggtttttactacggttttaagttttttaaaccgttacgtttacggttaaccgagggttaaaccttaaaggtttaaacttaaacgttaacccggtcgggtacccgtttaccgggtaccggttaccgggttaccggaaccggtaaaccggggtaacggttaaaacggggtacgttaaaacgtaaacccgtaaaaccgggtaacggtacgggttacggtccgtacgtaccctaacccgttaggttccgtcgtttccttaacccg

SEQ ID NO: 176158 - DNA, 693 bp, Homo sapiens
  misc_feature: GYAE6OF01CBFD8.2.74.G08.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
  modified_base (391)..(391): a, c, t, g, unknown or other
  misc_feature (391)..(391): n is a, c, g, or t
tcagacgctcgacacacgaccggtgctcgatttagtagctctatcagggggaggaactgctcagttaggacccagacggaaccatggaagcccgagcgcagcttctcttcctcctgctactctggctcccagataccacgtggaanaaatgtgatgacgcagtctcagccacctgtctgtgtctccaaggggaaacncgtccaaccctntcctgccagggccagtcagagttntagcagcaacttagcctggtaccagcagaacctgccaggcctcccaggtcctacgtcatcctagtcggtnctaactaccaacgaggcctacgtggtaacctcccgagccgaggttccaggtcgacaggtcggtctagggataacgcgtttacaccttnaccgaccaacgttcaactcgacgtaccctgactagttctagggaaattgtttacactttaagtttacccttagtacgtccgttaagacccgtaaaggttactaaacgttaaaccgtccgggtacccgtttacccgggtagggttaaccccggtttaccgggaaccgtaaaaccgggggaccctaaagggggtaaccgtaaaaaacgttccccgttaaaaacggggaccttttacgggacggggtaccctttacgggaacccctaccgttaaccgtttcgggttacccttcgtttaaccccgg

SEQ ID NO: 176159 - DNA, 617 bp, Homo sapiens
  misc_feature: GYAE6OF01EJS51.2.74.G08.1.454.CMB.1.raw
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaacagcccaccctctcctgccgagggccagtcagtagtgttagcagcaacgttagcctggtaccagtcagaaacctggaccaggcctccaggctcctctactntagtggtnacactccaacgacgggcacgtggtactcccgagccgtaggtcaggtggcgtaggtgggtcgtggaatagtacgttctacttctaccactacgtcagcctacgtcctgactagttctaagtagttacgttttgtacgtttaagtttacttacgtcgttacgtaacgtctaaggtaactttaacgtaacgttcggtacccgttccggttacggtccggtttacggaccggtaaacggggcgtaaagggtagaaacgttacgaaacggtaacggtcggtacggtactcggactaaccgattccgttgtccgttcc

SEQ ID NO: 176160 - DNA, 870 bp, Homo sapiens
  misc_feature: GYAE6OF01ETTPP.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgccgagggccagtcagagttgttacgcagacctaactttacgccgttaggtaaccaggaccaaacggaaaacccttcgggacccgaagggtcccgtacccccgagggtaccccttaccctacctaacgttaccgttagttacgggtcggacctaaccgtacccgaaaacggacggggtccctaacgtttacgggttaacctaccccgtaacggaccccgttaagggtttccgaaacggtttcggggaccgtaagggggttcggggtcgtttaaggggtaacttaagggttacgtttaccaaccgtttaccacccggtaacctacgttaccaacggccctaacggccttaggaccgtaggttacccgtaaggttaacgtttaacggttttttacggaacttttaaacgtttttaacgtttaaccgtttaggtaccggtaagttaaccgtaaaggttttaaaacgttaaaagttaaacgggttacgggtaaaccccttaaaacggggttaccccggtttaacggggaaacccggtaaaccgggggtaacccggtaaaggggtaaaccggtaaaacgttaaacccggtaaaaacggtaacggttagggtaccggtactaacggtaacccacttacgtttagtctttaacttccgtaaaccg

SEQ ID NO: 176161 - DNA, 687 bp, Homo sapiens
  misc_feature: GYAE6OF01AM2K9.2.74.G08.1.454.CMB.1.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (433)..(433): a, c, t, g, unknown or other
  misc_feature (433)..(433): n is a, c, g, or t
  modified_base (513)..(513): a, c, t, g, unknown or other
  misc_feature (513)..(513): n is a, c, g, or t
  modified_base (670)..(670): a, c, t, g, unknown or other
  misc_feature (670)..(670): n is a, c, g, or t
  modified_base (679)..(679): a, c, t, g, unknown or other
  misc_feature (679)..(679): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagcccaccctgtctgtntcctccgaaggggaaancgcccaccctctcctgccgagggccagtcagtacgttgttaagcagactaactttagccctggtaccagaccgaagaacccgtggacccgaggtcctcccgaggcctcctcattcgtagtggtcactactaccgaacgcgggaccctacgttacgggtactcccgacgcgtacggtttcgacggttcgacggtaggttgggtcgtagggtattacggtacgttaccgacctnttaccccaagttacacgacggtaccgaccgttcgaccgtacgttaggttaccgtaggttaaacggttttcgttttacggntttttaacggtttaacctttacgtcgttaccgtaagtaaccttaagttaacttaagttaacccggtcgttacccggttaggttaccgtaccgggttcccgaacggtaacggtacgaaagggtataaacgtacaaccgtaggtcgtcgtacacgtacncgtagtctnttccgtcg

SEQ ID NO: 176162 - DNA, 678 bp, Homo sapiens
  misc_feature: GYAE6OF01CMJNE.2.74.G08.1.454.CMB.1.raw
  modified_base (198)..(198): a, c, t, g, unknown or other
  misc_feature (198)..(198): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccacctctcctgcagggccagtcagagtgtagcagcaacttgcctgtaccagcaagaaacctggccaggcctcccgaggctcctcatctagtggtgcactccaacgagggccagttcggtactcccagccgtaaggttcgaggttggacgaggtgggtcgtagggatagtacgttccgactctaccacataccgacgcacgtccgtgacctaggttaccgtagtaaacgtttgttttcgacgtttaagttttaacttacttacggtactagtacgtaaaggtttacttaaacgttaaccgtcggttacccgttaccgggttacgggttaaccggtttccgggaaaccggtaaacggggtaacccggtaaacgggttaagggtaaaaaccggtaaccgtaaaaacgggttaaccgttgggtaacggtcccgttacgaacccgttacccgtaagtttcccgttggttaccctttaacccg

SEQ ID NO: 176163 - DNA, 832 bp, Homo sapiens
  misc_feature: GYAE6OF01B6OKX.2.74.G08.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccacgtggaagaaatagtgatggacgcagtcctccacgccctacccgtgtcctgtcgtcctaccgaaggggaaacncgcccacctctccngcgaggccagtcaagtgtgtagacacggactaacgtgccgtaggtacccagacctacgaaccgtcggaccgacggcctacccgaggcctccgtacacttacctagtacggtctaccactaaccgaacggtcggaccctacgttacggaccttacccgacgtacccgtaggtttacgaacgggtcggtacggtacgggttcggggttacgaaggggttaactaacggtaccggtttcaacccttccgtaacaaccgtaaccgtcgaaccgacgtacggtccctgaccgtagttccgtaaggtaacgttacgttttacggtaactttacggtttttaactaacggttccgttaaagtaacgggttaaccgttaaagttaacttaaaaccgggttacccggtaccgggtttaccccggttacgggttaaccggggttacccggttacggggtaaacccggtaaaacgggggtaaacccggttaaaaggggttaaacccggaaaacggttaaaacccgggtaaaaccgggttacggtttagggtaaccggttaaccggtaaccggtaaccgtaaccgtttacgtaccgtttccggtttcccttaaaccggg

SEQ ID NO: 176164 - DNA, 617 bp, Homo sapiens
  misc_feature: GYAE6OF01BTQV1.2.74.G08.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
  modified_base (445)..(445): a, c, t, g, unknown or other
  misc_feature (445)..(445): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgtagcagctaacttagcctggtaccagcaagaaacctggccaggcctcccgaggtcctcctnattctagtggtncactccaacgcgggccctagtggtactcccgagtccaggttcaggtggctagggttcgggtctgggataggtcgttcactcncaccatccgagcacgtctgcgtagttcgtagtaagttgtttgactttagtttacttacgtntacgtagtattaagtaattaacgtaccgtacggttcccttacgggtacgggttaccggttaccggaaccggtaaacggggtaccgtaaagggtaacggtaaactaaccggaaaggtaccggtgggtacggtcctacggtacccaacgttagtcccgttggttcctttacccg

SEQ ID NO: 176165 - DNA, 722 bp, Homo sapiens
  misc_feature: GYAE6OF01BVT2X.2.74.G08.1.454.CMB.1.raw
  modified_base (256)..(256): a, c, t, g, unknown or other
  misc_feature (256)..(256): n is a, c, g, or t
tcagacgctcgacacacgaccggtgctcgatttagtagctctatcaggggggaggaactgctcagttaggacccagacggaaccatggaagccccagcgcagcttctcttcctcctgctactctggctcccagataccactggagaaatagtgatgacgcagtctccacgcccacctgtctgtcgtctaccgaaggggaaacgacgccaccctctccgtgcgacggccagtcagtagtgtagcagactaacgtacnccgtaggtaccagacaagaaccgtggaccgacggcctacccgacgtcctaccgtcaacgtccgttagtggacgcctaacctaccgaacggacggtacctaacggtcgtaccgtacccgacgtccgtaggttcgaggtcggacggtagggtcggtacggtagggtaacgttacgtacgttccaccgtcgtaaccaccgagttacgacgaccacgggtcctggaaccgtgttacgtaaagttagtttacgtttacggttaccttttaagtttaaccgtggttaactcggtaactacgggttaattaacttaaacgtccggttccgtacccgggtttagaaccgggtttacgtaccggtaaaccgggaaacgggtaccgtaaaaggggtaactaaaccggaaacgtaagggaccgttacggaccggtaccacggtaaccttaccgtaatttcccgtgttacccttaccg

SEQ ID NO: 176166 - DNA, 737 bp, Homo sapiens
  misc_feature: GYAE6OF01B89VC.2.74.G08.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtatccgaggggaaancgcccaccctctccgtgcagggccagtcagtgtgttagcagctaacttgcctggtaccagcaagaacctggacaggcctcccgagcctccncatctagtggtcncgtaactaccgaacgcggggacctacgtacggtactcccgacggcccgtaaggttccgaggtcggacgtacgggttgggtcgtagggtataggttacgtcctaacgtcctacaaaccgtctccgacgtacacggtcccgttagaccgtaggtccgtaagttaaacggtttcgttttacgacgttttaagttttacgttacggttgtaacccgtaaggtacgttaaacgtttaagtaaaacgttaccggtccggttaacccggttaacggttaccgggtaaccgggttttaaccggacccggtaaaacgggggtaaccggttaaacggggaaacgttaaaaccggtacccgttaaaaacgggtaacccggtttggtacccgggttacgtacggtaacccctaacgtacccggtttactttcggtacccggtttacc

SEQ ID NO: 176167 - DNA, 880 bp, Homo sapiens
  misc_feature: GYAE6OF01AQ278.2.74.G08.1.454.CMB.1.raw
  modified_base (568)..(568): a, c, t, g, unknown or other
  misc_feature (568)..(568): n is a, c, g, or t
tcagacgctcgacacacgaccggtgctcgatttagtagctctatcagggggaggaactgctcagttaggacccagacggaaccatggaagccccagcgcagcttctcttccctcctgctactctggcctcccagactaccacgtggaagaaatagtgatggaccgcagtcctccacgcccaccctgtctggtcgtccgtaccggaagggggaaacaccgccccaccccgttcctccgtcggccgacggggccctaggtccgaggtagttcgttacggacacgactaaccgttcgaccgttacgggaccaagaccgtaaaccggtaacccgtgggcccgaaccgggtccctacccggtacggtccccttacccgtacgtaaccgttacgtaagggttcgggtccgaacctaacccggttacccgaaaaccggggtcccggggtaacccttaacgggttaccggtaaccccgtacccgaacgggttacccggttaacggtaccggtacggttacgggacgtttacggggtcggttaaggggtacggtaaggttaccgtaccgtttaaccncccgttacaacccgtaagtaccgtacgacgtaccgaccgtcggtacgtacgttaacggttagtaacggtttacgtttaacggtttcgttaaccgttttacggttttaaactccggttaacgttaccgtaacggtaaacgtttaacgttaaccgttaaacggttcccggttacccggttaccggttaccggggttaccggtaaccggtaccgggaacggttaaccgggaaggttaacgggtaaacgtaaaccggttaacgaacggtcggttacgcggtaccaccgtactacccgttatcggttccgtcttccg

SEQ ID NO: 176168 - DNA, 687 bp, Homo sapiens
  misc_feature: GYAE6OF01AMS1B.2.74.G08.1.454.CMB.1.raw
  modified_base (204)..(204): a, c, t, g, unknown or other
  misc_feature (204)..(204): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagacgctcgacacacgaccggtgctcgatttagtagctctatcagggggaggaactgctcagttaggacccagacggaaccatggaagccccagcgcagcttctcttcctcctgctactctggcctcccagataccactggaagaaatagtgatgacgcagtctccagcccacctgtctgtgtctaccggaagggggaaacncgcccaccctctccgtgcgacgggcccagtcagagtgtagcagacaacttgcctaggtaccagacaacgaaccnggaccagccnccgaggcctccactatcgtagtcggtcacactacccgaaggtaccgggcctacgtacggttaccctacccggacggtacccggtaacggttcggagggtcggacggtaggggttcgggtacgtggggtaatagggtcttactaccgtctaccgactagtaccgagccacgtccgtaggcctaggtttcgaagttaacgtttctttacgtacttttaagttaccgttacgtagtacgaagtaccttaaggttaacctaataccggttcggttacccgttaccggggtaggtccccggttacggaaccgggtaaacgggtaccgtaaagggtacgtaaaacgtacggtaaaccggtggtacggtccgagttccacctaagacgtttccgtagttccctacg

SEQ ID NO: 176169 - DNA, 791 bp, Homo sapiens
  misc_feature: GYAE6OF01CYN01.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctccagataccactggagaaatagtgatgacgcagtctccagccaccctgtctgtgtctccgaggggaaanacgccaccctctcctgacacgggccagtcagtacgttgtacgcagactaacgttagcctaggtaaccagactaaacggaaaccgtcggaccgaacgggcctacccgaggtcctcctctaattcgtaagtcggtacgactaacgtaccgaacgtacgggacctaacgtcggtaacctcccgaagtccgtaggttacacggttggacgtagggtcggggttactaggggtaacgtaacggtacgttaccgtaaccttcgtacccgaaacctagtaccaacggaccgtacgtaccccgttagaaccgtaacggtttcgttaaaggttaaacgtttacgttttcgaacgttttaagttttttaaaccgtacgttgggtttaacaacggttaacgttaacgtttaaagttaaaaccttaacgggtttccggtaacccggtttccgggttaacggggttaccggttaccggaaccgggtaaaacgggtaaccgtaaaaacgggttacggaaaacgtaaacgtaaaaccgggttacggttaggttaccggaaccgtttaggaccctaaaccgttacgtaccgtttacgttcccgtttaaccg

SEQ ID NO: 176170 - DNA, 752 bp, Homo sapiens
  misc_feature: GYAE6OF01C102M.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggcctcccagactaccactggaagaaatagtgatgacgcagtctccagcccacctgtctgtcgtcgtaccggaaggggaaacacgcccaccctctccgtagccgagggccagtcgagagttggtagcagaccaacgttagccgtaggtaaccagacaaggaaaccgtggacccgacggccctacccgaggcccttcctacacttacgtacgtggtcaccactacccggaacgtaccggacctacgtcgtacctcccgaagtccgtaagtccgaggtcggagtacgggttgggtcgtacggtaagtacgttacgtacctaccgtacgtaccctaaccgtagtccgaacgctaacggtcctaggactaacgttcgtaaggtaaagtttactttacggtaacttttaagtttaccgtaagttccgttaagaggttaaccttaagtttaaacgaacggttccgtacccgggtacccgttacgggttacggtaacccggttaccgggtaaacggaaaccggggtaaccgtaaggggtaaacgttaaaaccgtaccggtaaaacgggttacgtcgggttaacccggtgttaacccgaaacctacgtaaggtttcccgttaagtccctttaacccg

SEQ ID NO: 176171 - DNA, 842 bp, Homo sapiens
  misc_feature: GYAE6OF01B35G5.2.74.G08.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtcctccagccaccctgtctgtgtcctcgaggggaanacgccaccctcncctgcgacgggccagtcagagtgttacgcagtacaacgttgccgtaggtaccaggactaacgaaccctggacccgtaacggcctaccccgaaggtcccttacccctacgtaacttccgttaagttcgggttcgacctaactacccgaaaccgaacggggtccccaacggtttgggtaaccctccccggaatcccggtaagggtttaccgacggtttacgggccgtaaggggttcggggtcggttaggggtaactttaaggttaccgttcgacccgtttaccgtacccgaacccgttacggttaccacggtaccccgtacgtcccgtttcgacccggttaagttaccgttaagggtaaagttttaatttttcgggaaccgtttttaaagttttaccgttaaccttgggttaaccaagggttaccttaaagttaacgttaaacgtttaaccggtccggttacccgttaaccgggttccggggttaaacggtttaccgggaaaccccggtttaaacggggtaaccgtaaacggggtttaaacgaaaccgttaaccgtaaaaacgggtacgtttcgacggggtacgtacgtaacccgtaacggttacctttaccgggttacttcccggttttaaccg

SEQ ID NO: 176172 - DNA, 808 bp, Homo sapiens
  misc_feature: GYAE6OF01D6P9N.2.74.G08.1.454.CMB.1.raw
  modified_base (198)..(198): a, c, t, g, unknown or other
  misc_feature (198)..(198): n is a, c, g, or t
tcagacgctcgacacacgaccggtgctcgatttagtagctctatcagggggaggaactgctcagttaggacccagacggaaccatggaagccccagcgcagcttctcttcctcctgctactctggctccagataccactggaagaaatagtgatgacgcagtctccagccacctgtctgtgtcctaccgaggggaacncgcccacctctcctgcgagggccagtcagagttgttacgcgagctaacttacgccgttaggtaccagaccaacgtaaaaccgtcggacccgaacggcccttacccgacggttccttaccctaccgtagttccgttaagttcggggtacgacctaacgttacccgaaaccggtaccggggccctaacggtttaccgggtaccgttacccccgaagggttccccgtaagggtttaccgacggttcgggaccgtagggttccggggtacgtagggtacgtacggtacgttccacgttccttaccgaccgttacgtcgaacgtccctacgtcccgtagcgtaacggttcgtaaggttaacgttcgtttttacgcttttacggttttaattaccgttggaacttagtaaccgttaagtaacgtttaaacgttaccgttcggtacccggtttcggtaccgggttaccccggttccggaaacccgggtaaaccgggaaccggttaaaggtaacggttaaaaccgaaccgtttaaaccggacggtttccggaacgggttaccccacgggtaaccccttaaaccgttacgtttcccgttaacggtttcccttaacccgg

SEQ ID NO: 176173 - DNA, 713 bp, Homo sapiens
  misc_feature: GYAE6OF01ENUPB.2.74.G08.1.454.CMB.1.raw
  modified_base (197)..(197): a, c, t, g, unknown or other
  misc_feature (197)..(197): n is a, c, g, or t
  modified_base (317)..(317): a, c, t, g, unknown or other
  misc_feature (317)..(317): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgccagggccagtcagtagtgttagcagctaacttgcctggtaccagcaagaaccctggaccaggcctcccgaggcctcctctatctagtggtgcactccaacgngggccacgtggtactcccgagcctaggttcaggtggacgtaggtcgggtctgggtaactaggacgtttcaccgttccgtacctaacccgtattaccgacgtccgtaacgtccgtagaccgtagttaccgtaggtaaagtttacgttttggaccgttttaaggttttactttacgttacgttacgtaacgtagtaaggtttaaacttaaacggttaaccggttcggggtaacccggttacgggggttaacccggtttacccggggaacccgtaaaacgggggtaacccgtaaaggggttaacggtaaaacgtaccgtaaaaaccggtacggttaggcggggtacctacgggacccgtaaccctagtttacccggttacgtttaccttccgttacccg

SEQ ID NO: 176174 - DNA, 711 bp, Homo sapiens
  misc_feature: GYAE6OF01C0D80.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgcccaccctcctcctgcgacgggccagtcagagtgttagcagctaacttgccgtggtaaccaggactaacggaaacccgtggacccgacgggccctacccgaggtccttccgacattcctagttgggtcactaacgtacccgaaacgaccgggcctaacgttcggaacctccccgagtcccgtaggttacacggtcggacgtagggttcgggtcgtagggtaactaggtacgttcctacgttccctacgaccgtaactcgaacgtcgaccgtcctacggtaccgtaacggttccgtaaggttaaacgtttcgttttagtacgtttaacgttttaacgtaccgtttagtacgtacgtacgtaagttaataaacgttaccgtcgggttccgtaccgggttacgggtaccggttccggaaccggtaaacggtaacggtaaacgggtagtaaaacgtaccgtaaacggacggttaggaccgtcgtacgaccgaacgttcgtacgttctcgttacc

SEQ ID NO: 176175 - DNA, 626 bp, Homo sapiens
  misc_feature: GYAE6OF01DBTYZ.2.74.G08.1.454.CMB.1.raw
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagacgctcgacacacgaccggtgctcgatttagtagctctatcagggggaggaactgctcagttaggacccagacggaaccatggaagccccagcgcagcttctcttcctctgctactctggctccagataccactggagaatgtgatgacgcagtctccagccaccctgtctgtgtctccgaggggaaacngccaccctctcctgcacggccagtcagtagtgtagcagcaacttgctgtacngcagaacngccagctccagctctnatctatggncanccagnggcatgacnccagcngtcagtgcgtaggtcggtctgggatagacgtcgaactccgtacgaccagtcgaacggccacgtcctacggctacgtctagtaagtcttttgccgttaagttttactacgttacgttgacgttacgtaacgttacgttaaacgtaaccgtacgggttcccgtacgggttacgggttaccgggtttacccggaccgggtaaacggggtaacccgtaaacggggttacgaaaacccgttaacgtaaaccgggtacgttaccgggtaccggttacccgttaggacccctaacggttacctttaccgttccgggtttacctttaacccg

SEQ ID NO: 176176 - DNA, 906 bp, Homo sapiens
  misc_feature: GYAE6OF01EF2S8.2.74.G08.1.454.CMB.1.raw
  modified_base (242)..(242): a, c, t, g, unknown or other
  misc_feature (242)..(242): n is a, c, g, or t
  modified_base (458)..(458): a, c, t, g, unknown or other
  misc_feature (458)..(458): n is a, c, g, or t
  modified_base (581)..(581): a, c, t, g, unknown or other
  misc_feature (581)..(581): n is a, c, g, or t
tcagacgctcgacacacgaccggtgctcgatttagtagctctatcgagggggaggaactgctcagttaggacccaggacggaaccatggaacgccccagcgcagtcttctcttcctctgcttactcgtcgcctccagactaccagtaggaagtaagtgtagagtcggaccgacgtcgtcctaccgaccgaccccttaccgttgttccgttggtccgttaccggaacgggaaaggggaaaccncccgtaccccttaccctccgttacgcgacggaccggtactacggtacgtaggttacggttcgtacgaccgaacgtaccgtttaaacggtccgtaccgttacggaacgaccgaaccgtaaaccggtaccggtccgaccggtacgtacccctccggacgttccctccgtatttcggtacgtgggttacgacgtaccaaccgtaaccggcggacccgtnttaaccgttcgaacccgtaccggtcggtgtttaaccggcgtaaggtcggtacggttacggtacgggttagtacgtagttaccgtactttccgaccttacgacctacgtgaccgtcgttaccgngttaccgtaggtaccgttaggttacgttaacttacgggttttaactccgttttaacttttacggtttacttagtaccggttactaagggtttaacttaaacgtaccgtttaacggtcccgttccgggttaacccgttcggggttacccgttacgggtaaccggtacccgggttaaaaccggtaccgggttaaaaggttaaacccggtaacccgggttaaaacgtacggggtttaaccgggtaccggttaacggtttaccccgaaaccggtttacgttaacccgggttttaccttttaccgttacccggttacccgtttaacccgg

SEQ ID NO: 176177 - DNA, 673 bp, Homo sapiens
  misc_feature: GYAE6OF01CTLA7.2.74.G08.1.454.CMB.1.raw
  modified_base (447)..(447): a, c, t, g, unknown or other
  misc_feature (447)..(447): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtcctccacgcctaccctgtctgtgtctccgaagggaaagcgccacctctcctgcagggccagtcagagttgtagcagctaacttacgccgtggtaaccaagaccaagaaaccgtcggccaggccctacccgaggtcctcctctaacttctagttggtcaccactaccgaaacgcgggaccaacggtttacggtacctacccgacggtaccgtaacgggtttccgaagggtggtaccgtaaggggttcgggtcgtagggacttaggtacgttacactctacaacctnacacgtcgactcgtgacgtagtactagtaacggttatttaggtactttaaggtttattaccgtagtactacggtaacgagtttaaactaagttaccgtaccggtccttaccggggtagtaccggttacggaacccggaacgggtaacgaagggttaaggaaacgttaacgaaacggaaggtcgtaggtactacggtacctacgtaacgtttctgttaccgttaccg

SEQ ID NO: 176178 - DNA, 727 bp, Homo sapiens
  misc_feature: GYAE6OF01AJLFI.2.74.G08.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaancgccacctctcctgcaggccagtcagagtgttagcagctaagttacgcctggtaccagcaacgaacctggaccaggcctcccgaggcctccnctatcctagtggtcacactaccgaacgacgggtcccagttcgggtaacctccccggagtacccgtaggtttcgaaggttcggaccgtaaggggttcgggtacgttacggggtaattacgtacggtttccaaccttccgtaccaaccgtagttaccgacggtacctaacggtcccgtaggtaccgtaacggttacgttaacggtaacgttagtttttacgacgtttaacggttttacgtttaccgtacgttaccgtaagtaccgtaaggttaacttaaacgttaaccggtcgttacccgttacggttacgggtaccggttaccggtaacggtaaccgggtacgtaaggtacggttaaacgggtaaactaacgggtaaaaccggtaacgttagggtaacggtacgtacggtacccgaacctacgtttcgtacggttacccg

SEQ ID NO: 176179 - DNA, 666 bp, Homo sapiens
  misc_feature: GYAE6OF01E0AHK.2.74.G08.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
  modified_base (352)..(352): a, c, t, g, unknown or other
  misc_feature (352)..(352): n is a, c, g, or t
  modified_base (412)..(412): a, c, t, g, unknown or other
  misc_feature (412)..(412): n is a, c, g, or t
tcagacgctcgacacacgaccggtgctcgatttagtagctctatcagggggaggaactgctcagttaggacccagacggaaccatggaagccccagcgcagcttctcttcctcctgctactcgtggctcccagataccactggagaaatagtgatgacgcagtcctccagccacctgtctgtntctcgagggaancgcccaccgtctcgtgcgacgggccagtcagtgtgttagcgagactaacgttcgccgtcggtacacgacaacgaaaccgtcggaccgacggcctacccgaggtcctcctcacttctagtcggtgacactaccgaacggacggcctacgtacgtaccncccgacgtccgtaggttcgacgtggcgtagggttcggacgttgggtattacggtacttcnctaccgtacaccgtactacgacgcgtacgtccgtagtcgtagtcgtagtaacgttagttttcggactttagtttacctttcgtagtactacgtacgtaagttaactttaacgtccggttaccgggttccgttaccgggttacggttaccggttacgggaaccgaaagggtaccgtaagggtaacgaaaccgtaaccgtaacggtacgtcgggacgtccgtatacccgtacttaccgttcgttcgttcgttaccc

SEQ ID NO: 176180 - DNA, 872 bp, Homo sapiens
  misc_feature: GYAE6OF01CMPB4.2.74.G08.1.454.CMB.1.raw
  modified_base (117)..(117): a, c, t, g, unknown or other
  misc_feature (117)..(117): n is a, c, g, or t
  modified_base (207)..(207): a, c, t, g, unknown or other
  misc_feature (207)..(207): n is a, c, g, or t
tcagacgctcgacacacgaccggtgctcgatttagtagctctatcaggggggaggaactgctcagttaggacccagacggaaccatggaagccccagcgcagcttctcttcctcctncctactctggctcccagactaccacgtggaagaaatagtgatgacgcagtcctccacgcccaccctgtctgtgtcctaccgaaggggaanacgccctaccctctcccgtgaccgacggggacctagtacgagtacgttggttagaccgagtaccgtaaacgttcggtacccgtagggttaaccaccgaccgaaaccgggtaaaacccgtcgggaccccgaaacgggtaccctaccccggtaaccggtaccctttcccgttactacgtttaacccgtttaggtcgggttaccgtaccgaaacccgttaacccctaaacggggacccgggtaccctaaaccgggtttcgggtaaaccccttacccgacgtacccgttacgggttaccgtaacgggtacggacgttcggggttacggggtcgttaaagggtaacgtaccggttatacccgtaacgtccgtaaccttactacgtaccgacgtaccgacggtaccccttaggaccgttaactccggttaagttaaacggttttcgttttaacgggtccgttttaacgtttacgttacgtacgttacgtaacggtaacctttaacggtttaactaacggttacccttaccgggttccgtcccgggttaacggtccgggttacgaaccggttaaaccggggacgttaaacgggacgggtaaactaaccggtaaaggtaccgtcgggtagtaccgtaagccctaaacggtcttaacctcgtttacgtaccccg

SEQ ID NO: 176181 - DNA, 764 bp, Homo sapiens
  misc_feature: GYAE6OF01BS7KZ.2.74.G08.1.454.CMB.1.raw
  modified_base (204)..(204): a, c, t, g, unknown or other
  misc_feature (204)..(204): n is a, c, g, or t
  modified_base (512)..(512): a, c, t, g, unknown or other
  misc_feature (512)..(512): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagactaccactggaagaaatgtgatgacgcagtcctccagccctacccgtgtcttgtgtctccggaggggaaancgccacctctcctgcgaggccagtcgagtagttgtagcaagctaacgttcgcctacggtaaccaggtaccaacgtaaaccgtcggaccgacgggtcctacccgacggtcccttccctacgtaacttccgtttacggtttcggggtacgccgtaaccgtacccgtaaccggtaaccggggtccctaaccggttccgggttaacccttaccccggaacggttccggttaacggttcgtacggtcgggtacgtaggggttcgggtacggtcgggtaagtaggttaccgttccgaacgttctaccgtaaccngttacccgagaccgtacgtaccctgacgtaacgtttacgtaggttaacgtttacgttttcgacttttaagtttactttaactcggttacgtagtacgttaagttaacttaaacgtaccgtcggttaccgtcgggttacggtacccgttaccggacgggtaaacggaccgtaaagggtaacgtaaaccgtacgtaaacgttggtcggttaacgcgtacccgtacgtaccgttacgttacgtcttcgttaaccg

SEQ ID NO: 176182 - DNA, 829 bp, Homo sapiens
  misc_feature: GYAE6OF01A2F9M.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatgtgatgacgcagtctccagcccaccctgtctgtgtctaccgagggaancgcccaccctctcctgccgagggcccaggtcaggtacgtaggttacgctacgtaactaacgtttacgcccgttaggtaacccgagaccgaaaccgtaaacccgtcgggacccgtacgggaccctaccccggaggtccccttaccctctaacttcgttaacggtcgggtacgaccctaacgttaacccgaaaccgtaccggggtaccctaaccgggtttacggtaacccttacccccgaaggttccccggttaagggtttaccgacgggttcgggacggttacggggttcggttacggtagggttagtaacgtaccgtttacctacgtacctaccgacgtactccgacgtactacgtccgtacgctacgttacgtaaggtactttcgtttacgtcgtttaattttacgtacgttgtaccttaagtacgtaagttaaacgttaccgttaacccggttacgggttacccgttaccgggtttaacgggtacccggttacccgggtaaacggaacccggggttaaacgtaacggggtaaacgttaaaacccgtaaacggtaaaacccggttggttacccggacgggttacccacggtaacccggttaacttaccggttacgttcgttaccccttacg

SEQ ID NO: 176183 - DNA, 718 bp, Homo sapiens
  misc_feature: GYAE6OF01BUD0X.2.74.G08.1.454.CMB.1.raw
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
  modified_base (514)..(514): a, c, t, g, unknown or other
  misc_feature (514)..(514): n is a, c, g, or t
tcagacgctcgacacacgaccggtgctcgatttagtagctctatcaggggggaggaactgctcagttaggacccagacggaaccatggaagccccagcgcagcttctcttcctcctgctactctggcctcccagataccactggaagaatagtgatgacgcagtcctcagccctaccctgtctgtgtccgtaccgaagggggaaacaccgccctacccttcgtccgtggacgtacggggcctagtacgaggtaggttgttacggcaaggactaaacgtttacggccttaggtaaccagaccgaacgaaaccgtggaccgacggccctaccgaacggtcctacctactaagtccttaagtcggtacgactactaacccgaacgtaccgggacctaacgtcgtaacctacccgaggaccgtaggtcgaggtcggacgtaggtcgggtagtgggtaactaggtcttacnctcgtacacgtntcgacgcagctacgagtactacgtagttaaacgttntttaggacttttaaggtttaactttctagtactagtactaacgtttaagtaactaccggtcggtacccgttacgggtcggttaaccggttcgggaacccggtaaggggtaccgtaaaggttaacggaaaccgtttaacgaacgttacgggttgggacccgttacggtaactcccggaacttaacgtgttaccggttcttaacgg

SEQ ID NO: 176184 - DNA, 947 bp, Homo sapiens
  misc_feature: GYAE6OF01BMCBA.2.74.G08.1.454.CMB.1.raw
tcagacgctcgacacacgaccggtgctcgatttagtagctctatcgagggggagaactgctcagttacggacccagacggaaccatggaacgccccagcgcagcttctcttcctcctgctactcgtcggctacccagactaccactggaagtaaatgtgatagaccgctagtcctccacgccctacccttgtctcggtacgtccgtaccgggaaggggaaacgccgacccctaccccgttcgtcccgtaggaccggacggggtccctaacggtagtaacggtacggttaggtaaccggactaacggtaacccttaacgttaccggtccgttaacgggacccaacggaaccgaaacgtaacccggcggaaccgtaccggccgtaacccgcggttaccctcccgtacttaacgttccggtagtcggtccgtaaccacggtaaccccgaaacggtcggtacccttaacgtccggtacccaccgtacggtacggtacggttcgacggttcggggaacgtgggtttcggtacgggaggtaaacgtttcggtacccgtttcacccggttacctaacgttaccgacgttaaccggacgtacccgtacggttccccgtaaggttacccggttaacggtaaccggtttaaaccgggttagttttaacgggttttcccgtttaaaacgtttttaacggttttaacccctttgggttaacccgtttaaggtaaccgttaacggtttaaaacgtttaaccgtaaaaccgggtttaccggtcccggggttaaccccggttttaaaggggtacccccggttcggggtaaacccgggtaacgggtaaaaccggttaagggtaaaccgtaaacggttaaaacgaaaccgggttaaacggttgtaaaccgggatacccggacgttaacctcggttaaccgtttcggttacccttgttacccccg

SEQ ID NO: 176185 - DNA, 833 bp, Homo sapiens
  misc_feature: GYAE6OF01C7O5M.2.74.G08.1.454.CMB.1.raw
  modified_base (203)..(203): a, c, t, g, unknown or other
  misc_feature (203)..(203): n is a, c, g, or t
tcagacgctcgacacacgaccggtgctcgatttagtagctctatcagggggaggaactgctcagttaggacccagacggaaccatggaagccccagcgcagcttctcttcctcctgctactctggctccagataccacgtggaagaaatagtgatgacgcagtcctccagccctaccctgtctgtgtcctaccgaggggaaancgccctaccctctcctgccgacgggccaggtcagtagtgttacgcacggactaaacttcgccgtggtaacccaggacaaccgaaaccgtcggaccgaggcctcccgacggtcctaccctctacttccgtagttcgggcacctaaccgtaccgaaaccggtacgggaccctaacggttggtaaccctccccgaacggtccgtaacggtttcacggtcggtacgtacggggttcgggtgttagggtaattacggtacgttacctaccgttaccgtaccaaccgttacgtacggaccggttccgaacccggttcgtacgggacctttacggttacgtaaacgggtttaaattttcgggtttttccaaccggtttttaaagtttttaccgtaacggtttacgtcgtaaacggtattaaacgggttttaaactaaccggtttacgggtcccgtttaccgggttaccgggttaacggggtttaacccccgggttaccggggaacccgggtaaaacgggggttaacccggttaaagggttaaaccggtaaaacccgtaaacgtaaacccgggttacgttacggggttacgacctcggaaccgttaacccttggttaccctgtttacccgttaacccg

SEQ ID NO: 176186 - DNA, 861 bp, Homo sapiens
  misc_feature: GYAE6OF01D2966.2.74.G08.1.454.CMB.1.raw
  modified_base (148)..(148): a, c, t, g, unknown or other
  misc_feature (148)..(148): n is a, c, g, or t
  modified_base (353)..(353): a, c, t, g, unknown or other
  misc_feature (353)..(353): n is a, c, g, or t
tcagacgctcgacacacgaccggtgctcgatttagtagctctatcagggggaggaactgctcagttaggacccagacggaaccatggaagccccagcgcagctttctcttcctcctgcctactctggctcccagactaccactagganaaatgtgatgaacgcagtcctaccgacgccctacccgtgttcgttcgtgtacctaccggaagggggaaacgaccgtccccaacccccgttcctcccgttggcggacgggacccgtaacgtacgaggtaagttgttaacgactacggactaacgtcgtaccgtacggtacacgacgaaccggtaaccgtcggaccgaccggtaccnccgtacggtcctaccctacgtacttcgtaggttcggtagacctaccgtaaccgaacggacggtacctagttcggtaacctccgaaccgtaccgtacggtacgacggtacggtacgtacggggttggtaacggggttacgggtaatacggttacgtaccaccgttttacaaccttacgactacgaacgaccgtaacgtcccgtgtacgtacgttacgtaacggttaacggtttacttttacggtttaacccgtttggttttaaactttaccgttaacccgggttaagtaaccctaggttaaacgttttaacctaaaaccggttttaccggtacccggttaccccgggtttaaccgggtttaccgggtaaccccggtttacggggtaaccccgggtaaacggtaaccgggtaaagggttaaactaaaccgggttaaccgaaaccgttagggttaaccggtaacgacgttaaccgtaaccgtacctaagttttcctcgttctttaacccgg

SEQ ID NO: 176187 - DNA, 482 bp, Homo sapiens
  misc_feature: GYAE6OF02GPKW5.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaacagggccactggtatcccagccaggttcagtggcagtgggtctgggatagagttcactctcaccatcagcagcctgcagtctgaagtattttgctagtttattactgtcagcagtataatactgcctcgtgacgttcggcagggaccaggtgaatcaacgatgtgctgcacatctgtcttc

SEQ ID NO: 176188 - DNA, 514 bp, Homo sapiens
  misc_feature: GYAE6OF02G5EAS.2.74.G08.1.454.CMB.1.raw
  modified_base (224)..(224): a, c, t, g, unknown or other
  misc_feature (224)..(224): n is a, c, g, or t
  modified_base (418)..(418): a, c, t, g, unknown or other
  misc_feature (418)..(418): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
tcagacgctcgacacacgaccggtgctcgatttagtagctctatctagggggtaggggaactggactcagttacgggacccccaggacggtaaccagtggaagccccgagcgcaggccttcgtccttcctccctggcctaacgtctggtcctcccagactaccactggagaagtagtgataggacgcagtctccagccaccctgtctgtgtctccaggggaaangcccaccctctcctgcagggccagtcagagtgttagcagcaacttagcctggtaccagcagaaacctggccaggctcccaggctcctcatctatcggtgcatccaacagggcccacgtggtactcccgagcccaggttcagtggcagtgggtctgggatagagttcactctcacctatcagcagcctgcagtcngaagtattttgctagtttattactgtcagcagtataatactgcctcgtgcgttcgcaggaccagtgaatcaagactgngctgcaccagtctgtntc

SEQ ID NO: 176189 - DNA, 480 bp, Homo sapiens
  misc_feature: GYAE6OF02IW99D.2.74.G08.1.454.CMB.1.raw
  modified_base (478)..(478): a, c, t, g, unknown or other
  misc_feature (478)..(478): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaacagggccactggtatcccagccaggttcagtggcagtggtctgggatagagttcactctcaccatcagcagcctgcagtctgaagtatttgctagtttattactgtcagcagtataatactgctcgtgacgtcgacgaggacaggtgaatcaaacgactagtgctgcaccatctgtntc

SEQ ID NO: 176190 - DNA, 521 bp, Homo sapiens
  misc_feature: GYAE6OF02H99HG.2.74.G08.1.454.CMB.1.raw
  modified_base (207)..(207): a, c, t, g, unknown or other
  misc_feature (207)..(207): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctcncctgcagggccagtcagagtgttagcagcaacttgcctggtaccagcaagaaacctggccaggctccaggctcctcatctatggtgcatccaacacgggccactggtactcccagccaggttcagtggcaggtcccgggtntgggataggngttcactctcacctatcagcagcctgcagtctagaagtntttgctagtttattatgtcagctagttaataataactggtccttcgtggtaccgttcggaccgtaagggaccgtaagggtaggaaatacgaaacgtacgtgtaggctgacacctatctgtcttc

SEQ ID NO: 176191 - DNA, 518 bp, Homo sapiens
  misc_feature: GYAE6OF02FN5X0.2.74.G08.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (389)..(389): a, c, t, g, unknown or other
  misc_feature (389)..(389): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaanagggccactggtatcccagccaggttcagtggcagtgggtctgggatagagttcactctcaccatcagcagcctgcagtctgaagtntttgcttagtttattactgtcagtcagtaataataactggtacctcgtgtacgttcggaccgaagggacctaagggtaggaaacgtacgaaacgtaacgtggtacggctgaccaccatctagtcttacg

SEQ ID NO: 176192 - DNA, 501 bp, Homo sapiens
  misc_feature: GYAE6OF02HV1HW.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaacagggccactggtatcccagccaggttcagtggcagtgggtctgggatagagttcactctcaccatcagcagcctgcagtctgaagtattttgctagttttattactgtcagcagtataatactgcctcgtggtacgttcggaccaagggaccagggtaggaagtacgaaacgtacgtgtaggctgcaccatctgtctac

SEQ ID NO: 176193 - DNA, 521 bp, Homo sapiens
  misc_feature: GYAE6OF02IHU2K.2.74.G08.1.454.CMB.1.raw
  modified_base (196)..(196): a, c, t, g, unknown or other
  misc_feature (196)..(196): n is a, c, g, or t
  modified_base (412)..(412): a, c, t, g, unknown or other
  misc_feature (412)..(412): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaacagggccactggtatcccagccaggttcagtgcagtgggtctgggatagagttcactctcaccatcagcagcctgcagtctgaagtattttgctagtttattactgtcagnagtataatacgtggtccttcgtggtaccgttcggaccgaagggacctagggtagaaacgtcgaaacggaacgtgtaggacgtcgaccaccgtatcgtacgttcttaccg

SEQ ID NO: 176194 - DNA, 709 bp, Homo sapiens
  misc_feature: GYAE6OF02F09WR.2.74.G08.1.454.CMB.1.raw
  modified_base (205)..(205): a, c, t, g, unknown or other
  misc_feature (205)..(205): n is a, c, g, or t
tcagacgctcgacacacgaccggtgctcgatttagtagctctatcagggggacgaaactgcctcaggttaggacccacgacggaaccatggaagccccagcgcagcttctcttcctcctgctactctggctcccagataccacgtggagaaatagtcgatgacgcagtctccagccaccctggtctggtgtctccgaggggaaancgccgaccctctcctgcagggccagtcagagtgttagcagcaacttagcctggtaccagcagaaacctggacctaggctcccgaggcctccctcatctagtgggtgcgatccaacgacgggcctaagtggtactcccagcctaggttccaggtcggctaggtgggtacgtgggataggacgttacacgttccgtacaaccctactaccgaacgcctacggtccctagacctacgtcgtaggtaagttacgttttacggaccttaaattttacgttaacgttcggttacgtaagtaccgtaacggttaacttaaacgttaaacggttacgggtaacccgtaaaagggttacccgggtttaccgggaaacccggttaaagggggtaacccgtaagggggttacggtaaaacgttacccggtaaaaaccgggtaacgtttacgggtaacggtaccgttacggacctaaccggtagttacccgttacggttacctttacggtaaccgg

SEQ ID NO: 176195 - DNA, 644 bp, Homo sapiens
  misc_feature: GYAE6OF02IUUY5.2.74.G08.1.454.CMB.1.raw
  modified_base (196)..(196): a, c, t, g, unknown or other
  misc_feature (196)..(196): n is a, c, g, or t
  modified_base (336)..(336): a, c, t, g, unknown or other
  misc_feature (336)..(336): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctctcatctatggtgcatccaacaggtccactcgtagtccacgacgacgtacgtacgnggtcgagtggtcgtggtagtagtagtctactactcctaccaactcacgacgacgccgtcgtcgacgtcgtagaagtagtttagttcgtacgtttaagttttacttacgtcgtacgacgtacgttaagttaaattaaacgtacggttaccgttaccggttaccgggttacgggtttacccgggaccggaaccggggtaaccggtaacgggttaagggtaaacggtaaaccgtaaaccggtaaaccggtacggttacgggtaccgttacggtacgtaacccgtaacctacgtttaccggttacgttaccg

SEQ ID NO: 176196 - DNA, 533 bp, Homo sapiens
  misc_feature: GYAE6OF02HZESN.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtgcatccaacagggccactggtatcccagccaggttcagtggcagtgggtctgggatagagttcactctcaccatcagcagcctgcagtctagaagtattttgactagttttattacgtgtacagtcagtaataataacgtgccttcggtggtacgttcggaccgtaagggaccgtaagggtacggaaagtaccgaaacggaacttaggtaggacttacggaccaaccagttctgtccttcg

SEQ ID NO: 176197 - DNA, 546 bp, Homo sapiens
  misc_feature: GYAE6OF02JIBRJ.2.74.G08.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctcccaggctcctcatctatggtgcatccaacgnggggcccaacgtggtactccccagccctaggttcaggtggctaggtgggtctgggatagngttcactcncacatcngcagcctgcagtctagagtatttgctagtttatacgtgtactagctaagttactaattacgtcggtaccttccggtagggtaccgttcggaccgtaacgggaccgtaggtaggtaacgtacgaaacgtacgtagtacggtctacggcaccgtatacgtgtacttacg

SEQ ID NO: 176198 - DNA, 510 bp, Homo sapiens
  misc_feature: GYAE6OF02IMQ55.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaacagggccactggtatcccagccaggttcagtgcagtgggtctgggatagagttcactctcaccatcagcagcctgcagtctgaagtattttgctagttttattacttgtcagctagtataataactgccttcgtggtacgttcggaccgaagggaccagggtaggaactacgaaaccgactggtcgacgtgaccaccatcttgtcttac

SEQ ID NO: 176199 - DNA, 595 bp, Homo sapiens
  misc_feature: GYAE6OF02JNK1F.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctgtctcccagataccactggagaaatagtgatgacgcagtctccagccaccctgtctgtgtctccaggggaagagccaccctctcctgcagggccagtcagagtgttagcagcaacttagcctggtaccagcagaaacctggaccaggctcccgaggctcctcatctagtgtgcatccaacacggggcctaacgtggtactccccgagcccgtagggttcaggttggccgaggttcggggtctggggaacttaggagttccacgttctacaaccctagtccacgtcgacgtcccgtggccagttctaggtaaagttattttcgcttagttttattaacgttgtacagtcgtaagttaataactacgtggtcccttacgtcggtacgttacggaccgtaagggtacccgaagggtacgtaaacgtcgaaaacgacgttggacggtactcggacgacctatcgttacgtcttacg

SEQ ID NO: 176200 - DNA, 654 bp, Homo sapiens
  misc_feature: GYAE6OF02H1F1Y.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgcagggccagtcagagtgttagcagcaattagcctggtaccagcagaaacctggccaggctcccaggctcctcatctatggtgcatccaacgacgggccactcggtactcccgagccaggttcgaggtcggcgaggttcggggtcgtgggtaactaggtacgtttcaccgttcctaccacctacgtcacgcgtacggccttggctagtctaggtaaagttagtttttcgtaccgttaagttttttaacttacgttagtacgtaaggtacgtaaagttaaacttaaacgttaacggtcgggtacccggttagggtaccgtttccggggaacctaaacgggggtaaccaaaggggttacggaaacctaaccggaaaaaccggtaacgtttgggacggtactaccggactacccgtaagttccgtacgttaccgttactaacccg

SEQ ID NO: 176201 - DNA, 536 bp, Homo sapiens
  misc_feature: GYAE6OF02FLD1I.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtccccaggggaaagagccaccctctcctgcagggccagtcagagtgttagcagcaacttagcctggtaccagcagaaacctggccaggctcccaggctcctcatctatggtgcatccaacaggggccactggtatcccagccaggttcagtggcagtgggtctgggatagagttcactctcaccatcagcagcctgcagtctgaagtatttgcttagtttatactgtcagcagttataataactggtaccttcggtggtaccgttcggaccgaagggtaccaaggttaggaaatcgaaaacggaacttggtaggaccgttggactaccgtagttctacggttccttactaaccg

SEQ ID NO: 176202 - DNA, 491 bp, Homo sapiens
  misc_feature: GYAE6OF02HGWCJ.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaacagggccatggtactcccagccaggttcagtgcagtggtctgggatagagttcactctcaccatcagcagctgcagtctagaagtattttgctagtttattactgtcagctagtataatactgcctcgtgtacgtcggacgaacggacgaggtagaagtacaacgtatgtagcgtgacacatctgtcttc

SEQ ID NO: 176203 - DNA, 678 bp, Homo sapiens
  misc_feature: GYAE6OF02H1MJW.2.74.G08.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaanacgcccaccctctcctgcagggccagtcagagtgtagcagacaattcgcctggtaccagcaacgaaacctggaccaggcctcccgaggcctcctcatctagtggtncataccaacgcgggcccactggtactcccgaagcccgtaggttcaggtcggcgtagggttcggggttcgtggggtaattacgggtacgtttacaaccttcgtaccgaaccctagttccaacggtccgaacggtccccgtggacgtacggttacgtacggtaagttacgtttttggactttaaggttttttaacttacgttacggttacaacgtacgtaagttaaattaaaacgttaccgtcgggtacccttaccgggttagggtaacccgggtttcggaacccggtaaacggggaacccgtaagggttacggaaaacgtacgaaaaccggtagtacggtagcgtacgaccaccgtactcggttcgtacttaccg

SEQ ID NO: 176204 - DNA, 569 bp, Homo sapiens
  misc_feature: GYAE6OF02HL1WR.2.74.G08.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (393)..(393): a, c, t, g, unknown or other
  misc_feature (393)..(393): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggcctcctcatctatggtgcatccaacngggccatggtactcccagccaggttcagtggcaggtgggtctgggataggattcactctcaccatcagcagcctgcagtctagtaagtnttttgacttagtttacttacgtgtcagtcagttataattaacgtggtaccttccggtaggtaccggttcggaccgtaagggacccgtaagggtacggtaaacgttacgaaaaccggtaacgttaggtacgggaccgttacggacctaaccgtacgttaccgttacgtcctttaccg

SEQ ID NO: 176205 - DNA, 516 bp, Homo sapiens
  misc_feature: GYAE6OF02HE0KD.2.74.G08.1.454.CMB.1.raw
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaaacctggccaggctcccaggctcctcatctatggtgcatccaacagggccacgtggtactccccagccaggttcagtcggcaggtgggtctgggataggagttcacttcctacacctatcagcagcctgcagtctagtaagtntttgctagtttattactgtcagntagtataatactggtcctcggtgtacgtcggacgaagggtacgaggtagaagtacaaacgtacgtgtacgactgacacctatcgtgtactc

SEQ ID NO: 176206 - DNA, 488 bp, Homo sapiens
  misc_feature: GYAE6OF02FXXPL.2.74.G08.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttgcctggtaccagcagaaacctggccaggctcccaggcctcctcatctatggtncatccaacagggcccactggtactcccagccaggttcagtggcaggtggtctgggatgagttcactctcaccntcagcagcctgcngtctgaagtatttgcttagtttattactgtctagctagtataatactgcctcgtgacgtcggacagggacaggtgaagtcaacgactgtcgntcgcaccntctcgtntc

SEQ ID NO: 176207 - DNA, 481 bp, Homo sapiens
  misc_feature: GYAE6OF02HJRQN.2.74.G08.1.454.CMB.1.raw
  modified_base (196)..(196): a, c, t, g, unknown or other
  misc_feature (196)..(196): n is a, c, g, or t
  modified_base (477)..(477): a, c, t, g, unknown or other
  misc_feature (477)..(477): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttgcctggtaccagcagaaacctggccaggctcccaggctcctcatctatggtgcatccaacagggccactggtatcccagccagttcagtggcagtgggtctgggataggagttcactctcaccatcagcagcctgcagtctgaagtattttgctagtttattactgtcagcagtataatactgcctcgtgacgtcgacgaggaccaggtagaagtcaacgatgtgctgcacatctntctc

SEQ ID NO: 176208 - DNA, 540 bp, Homo sapiens
  misc_feature: GYAE6OF02H68DL.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttgcctggtaccagcagaaacctggccaggctcccaggctcctcatctatggtgcatccaacagggccactggtatcccagccaggtcagtggcagtgggtctgggatagagttcactctacaccatcagcagcctgctagtctagaagtattttgcttagttttattactgtcagctagtattaatacgtgtcctcgttggaccgttcggaccgtaagggacctaagggtacggaaacgtcgaaaacggtacgttacggtacggtcgtacgtcctaaccgtacttcgttcgttcttaccg

SEQ ID NO: 176209 - DNA, 618 bp, Homo sapiens
  misc_feature: GYAE6OF02I6WRZ.2.74.G08.1.454.CMB.1.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
tcagacgctcgacacacgaccggtgctcgatttagtagctctatcgagggggaggaactgctcagttaggacccagacggaaccatggaagcccagcgcagcttctcttcctcctgctactctggctccagataccactggagaatagtgatgacgcagtctccagccaccctgtctgtgtctccaggggaaangccacctctcctgcagggccaggtcagagtgttagcagcaattgcctggtaccagcagaacctggccaggctcccaggcncctcatctatggtcncatccaagacgggccaactcggtatccccgagcctagggttccagtcggctaggtcggtctaggggataaggnggtttccacttctaccgaacctagttacgaagcgtacgtccgttcgaccgtagtccgtaggtaaagtacgttttgacgtttaagttttactttacgtagtttaccgagtaccggtaattagttaaacttacgtaggtaccccttcgggttacgggaacggtttcggacccgaagggtaccctaagggtacggtaaacgtacggaaacgtacgtaacgggtcgtacgtagtccgaccttagtccgttactgttaccc

SEQ ID NO: 176210 - DNA, 550 bp, Homo sapiens
  misc_feature: GYAE6OF02I2ZNM.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggaccaggctcccaggcctcctcatctatggtgcatccaacgagggccacgtggtactcccagcctaggttcaggtggcaggtgggtcgtgggataggagttcacttctcaccatcagcacgcctgctgtctgtaagtattttgcttagtttattactgtcagctagtataatactcggtcctcggtaggtaccgttcggaccgtaacgggaccgtaggtacggaaacgtacgaaaccggtaacgtcggtacggtactggacctaccgacgtcgttcgttccttaccg

SEQ ID NO: 176211 - DNA, 615 bp, Homo sapiens
  misc_feature: GYAE6OF02GHHYG.2.74.G08.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagtagtgttagcagcaacttagcctggtaccagcagaacctggccaggcctcccgaggccttcctcattctagtggtnctactccaacgcgggccctacgttggtaactcccgagtccgtaggttccaggtcggctagggttgggtctaggggataggtacgtttcacgttctacacctatccgagcctacgcctgactaggtctaggaagttntttcgacgttaagttttacttacgttcgtactagtactaagttaataacgttacctcgggtcccttacggtaggtaccggttaccggacgtaacgggaccgtagggtacggtaaacgtcgaaaaccggtacgtggtacggtccgtacgccacccgtattccgttacgtccttaccg

SEQ ID NO: 176212 - DNA, 590 bp, Homo sapiens
  misc_feature: GYAE6OF02GPZBF.2.74.G08.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcagcaacttagcctggtaccagcaagaacctggccaggcctcccaggctcctcatctagtggtncactccaacgacgggccacgtggtactccccgagcccaggttccaggtggctaggtgggtcgtgggataggagttcactctcacctatcagcacgcctgcagtctaggaagttattttggacttaagtttttacttacgttcgtactaggacctaagttaataaacgttacgtcgggtcccttacgggttcgggtaccgttaccgggaccgaacggggacctaacgggttaggaaactaccggaaaacgtacgtggtacggtctacgtaccgaccttagtcgtgttcttaccg

SEQ ID NO: 176213 - DNA, 586 bp, Homo sapiens
  misc_feature: GYAE6OF02JHHQY.2.74.G08.1.454.CMB.1.raw
  modified_base (282)..(282): a, c, t, g, unknown or other
  misc_feature (282)..(282): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctccncatctatggtgcatccaacgagggcccactggtactcccgagccaggttcagtggcagtgggtctgggataggagtttcacttctcaccatcacgcacgcctgcagtctgtaagtagttttgacttagtttattactgttcagtctagttaataattaacgtcggtaccgttcggttagggtaaccggtttccggaaccggtaacgggacccgtaaggggttaaggtaaacgtaccgaaaacgtaacgttcggtacggtaccgttacggacctaaccgtacgttcgttacgttaccgtttaccg

SEQ ID NO: 176214 - DNA, 497 bp, Homo sapiens
  misc_feature: GYAE6OF02FNZN9.2.74.G08.1.454.CMB.1.raw
  modified_base (195)..(195): a, c, t, g, unknown or other
  misc_feature (195)..(195): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttagcagcaacttagcctggtaccagcagaaacctggccaggctcccaggctcctcatctatggtgcatccaacagggccacgtggtactcccagccaggttcagtggcagtgggtctgggatagagttcactctcaccatcagcagcctgcagtctgaagtattttgcttagtttattactgtcagcagttataatactgcctcgtggtacgttcggccaagggaccaggtagaacgtcgaaacgacgtgtacgctgcacatctgtctac

SEQ ID NO: 176215 - DNA, 574 bp, Homo sapiens
  misc_feature: GYAE6OF02HSY43.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcaagaaacctggccaggctcccaggctcctcatctatggtgcatccaacgagggccacgtggtatcccagccaggttcagtcggacaggtggggtctgggataggagttcactctcacatcagcagcctgctagtctgaagtattttgcttaagtttacttacgtgtacagtactagttaataagtaacgtgggtaccctacggttcgggtaaccggttccggaccgtaacggggtaaccgtaagggtacggtaaacgtaacgaaaccgtaacgtggtacggtacgtacggtaccaacctagtcgttcgttaccgttaccg

SEQ ID NO: 176216 - DNA, 535 bp, Homo sapiens
  misc_feature: GYAE6OF02H1BK0.2.74.G08.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
tcagacgctcgacacacgaccggtgctcgatttagtagctctatcaggggaaggaactgctcagttaggacccggacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcagaaacctggccaggctccaggctcctcatctatggtgcatcccaacngggccactggtactcccgagcctaggttcaggtggcaggtgggtctgggataggagttcactctacacatcagcagcctgcagtctagaatntttgcttagtttattactgtcagcagttaataataactcggaccttcggtggtacgttcggacgtaagggaccaaggtagaaactacgaaacgtacgtggtacggctaggacctaccgtattcgttagttccttactacg

SEQ ID NO: 176217 - DNA, 598 bp, Homo sapiens
  misc_feature: GYAE6OF02F0CGN.2.74.G08.1.454.CMB.1.raw
  modified_base (197)..(197): a, c, t, g, unknown or other
  misc_feature (197)..(197): n is a, c, g, or t
  modified_base (428)..(428): a, c, t, g, unknown or other
  misc_feature (428)..(428): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggcctcccgaggctcctcatctagtggtgcatccaacgcgggcccacgtggtactccccgagcctaggttcaggttcggactagggttcgggtcgtaggggacttaggacgtttccacgttctaccacctatcgacgcacgcctgctagtctagaagtntttgacttagttttattcgtcgtacagtactaagttaataacgttacgtcggtacccttccgggtagtaccggttccggaccgaaacgggtaccgtaagggtacgaaacgttacggaaacgtaacgttcggtacgtacgtacgacctaccgtatccgttcgtcctttacg

SEQ ID NO: 176218 - DNA, 613 bp, Homo sapiens
  misc_feature: GYAE6OF02IHDJJ.2.74.G08.1.454.CMB.1.raw
  modified_base (195)..(195): a, c, t, g, unknown or other
  misc_feature (195)..(195): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcagcaacttagcctggtaccagcagaaacctggccaggctcccaggctcctcatctatggtgcatccaacagggccacgtggtactcccagccaggttcagtggcaggtgggtctagggataggagtttcgaccttctccacctatacgacgcacggtccctggccaagttcctaggtaaagttgtttttaggaccttaaggtttttaacttacgtcgttactaggtcctaagttaacttaaagttaacgtcgggtaccctttaccgggtacggttaaccggtttcggacccgtaaacggggaccgtaagggtaggtaaactaccgaaacggtacgtaggtacggacctaggacccaccgtaattccgtcgttaccttaccg

SEQ ID NO: 176219 - DNA, 699 bp, Homo sapiens
  misc_feature: GYAE6OF02JOVN7.2.74.G08.1.454.CMB.1.raw
  modified_base (109)..(109): a, c, t, g, unknown or other
  misc_feature (109)..(109): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagacgctcgacacacgaccggtgctcgatttagtagctctatcagggggagggaacgtgctcagttaggacccagacggaaccgatggaagccccagcgcagcttcncttcctcctgctactctggctcccagactaccactggagaatagtgatgacgcagtctccagccaccctgtctgtgtctccaggggaaanagccaccctcncctgcagggccagtccagngttcgttagcgacgcaaacgttcgccttggtaacccaggccaagaaaaccctgggacccacggtcctccccgaagggtcctccctacgtacctcgttacgtcggtcgacacgtccaaacgtacggggccctacgtacggttaactccccgaacggtacccgagggtttaccgaacggttcggggcttaacggggtcggggttaccgttaggggtaaccgtaggtacggttaccgtacgttcccgtaccaacccgtagtaccgtaacggcctaaccggcccttaggacctagtccgtacgtaaagttacgttttagccgttaaggtttacttacgtgttacgagtactaagttaaattacgtaacgttcgtaccccgtaggtcggtaccgtcggaccgtacggaaccgtaggtaaggaaccgtagtaaactacggacgtcgtagcgacctacacggtcttacgtcgttccg

SEQ ID NO: 176220 - DNA, 528 bp, Homo sapiens
  misc_feature: GYAE6OF02FSMZ2.2.74.G08.1.454.CMB.1.raw
  modified_base (197)..(197): a, c, t, g, unknown or other
  misc_feature (197)..(197): n is a, c, g, or t
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaataggtgatgacgcagtctccagccaccctgtctgtgtctccaggggaaangcccaccctctcctgcagggccagtcagagtgtagcagcaacttgcctggtaccagcagaacctggccaggctcccaggcctcctcatctatggtgcatccaacgagggcccacgtggtactcccagccctaggtcagtggcaggtgggtctgggatagagttcactctcaccatcagcagcctgctagtctagaatgtttgcttagtttattagtgtcagtntagtaataatacgtgtcctcggtgtacgttcggaccgtacgggacgtaggnggtaaacgtacgaacgtacgtgtacggacgtcgccacctagtcgttacgtcttaccg

SEQ ID NO: 176221 - DNA, 617 bp, Homo sapiens
  misc_feature: GYAE6OF02F9BYZ.2.74.G08.1.454.CMB.1.raw
  modified_base (195)..(195): a, c, t, g, unknown or other
  misc_feature (195)..(195): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccggccacctgtctgtgtctccaggggaaangccaccctctcctgcagggccagtcagagtgttagcagcaacttagcctggtaccagcaagaacctggccaggctcccaggcctcctcatctatggtgcatccaacgacgggccacgtggtactcccgagcctaggttcaggtcggcaggttcgggtctggggattaggtagttcacgtctaccaccatcagcacgtcctgacgtacgtcgtagtaagttagttttgacttaagtttattacgttgttacagtactaagttaattaaactacgttacggtcccgttacggttcgggtaaccggtttcggaccgtaaacggggaaccgtaagggtacggtaaacgtaccggaaaacggtaacgttcgggtaacggtcgtacggacctaaccgtacgttccgtttacgttacctttacctaccg

SEQ ID NO: 176222 - DNA, 693 bp, Homo sapiens
  misc_feature: GYAE6OF02II3RQ.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggcctcccaggctcctcatctatcggtgcactaccaacgacggggcccacgtcgggtaactccccaagtcccgtaaggttcaacggttggactaagggttcggggtactggggtaattacggtacgtttccgaaccttccgtaccgaacccgtattccgaacggtcctaacggcccttacggtccgtaacggttacgtaggtaaacgtttacgttttacggaccttaagtttttaacttacgttcgtacgtaaggtactaaaggttattaaacgttaaccgtacgggtaccggttgggttaaccgttcgggaacccggtaaaggggtacccgtaaagggtacgtaaaacgtaccgtaaaacgggtacttcgggtacggtccgtacggacctaacgtacgttccgtagtttaccgtacgtaaccg

SEQ ID NO: 176223 - DNA, 565 bp, Homo sapiens
  misc_feature: GYAE6OF02HI3MA.2.74.G08.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgtagcagcaacttgcctggtaccagcagaaacctggccaggcctccaggctcctcatctatggtgcactccaacgngggccacgtggtactcccgagccaggttcagtggcaggtgggtctgggaatagagttcactctacactatcagcacgcctgcagtctagtagtattttgacttagttttactacgtgtcagtacctagtaacttaaagtaccgtggcccttcgggtacgtaaccggttcgggaccgtaaaggggtacccgtaagggtacggaaacgtaacgaaaccggtaagtcggtacggctacggacctacgtatcgtagttccttacg

SEQ ID NO: 176224 - DNA, 653 bp, Homo sapiens
  misc_feature: GYAE6OF02I5XSD.2.74.G08.1.454.CMB.1.raw
  modified_base (195)..(195): a, c, t, g, unknown or other
  misc_feature (195)..(195): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (315)..(315): a, c, t, g, unknown or other
  misc_feature (315)..(315): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctcagccacctgtctgtgtctccgaggggaaancgccacctctcctgcagggccagtcagagtgtagctagctaacttgcctaggaccagcagaactggcagcnccagctcnatctagcgtcgcaactcaaacgtcgggccaagtggtaaccnccgtagtaccgtaggttcaggtcggacgtagggttcggtacgtaggaacttaggttaccgttacaaccttccgacgtaactactacgagaccgtacgacgtacgactacggttacgtaacgtaagttacgtttacgaacgtttaacgttttacgttaacgtgtacgtagtacgtaagttaactaacgtacggtaccgtaccgttacgggtacggtaccgttacggaaaccggtaacgggtaaccgtaaggtaacggtaactaaaccggtaaacggttacgtacggtacggtaccgtaactaccggtaacgttaacgttcgttaccgttaccgttaacg

SEQ ID NO: 176225 - DNA, 718 bp, Homo sapiens
  misc_feature: GYAE6OF02G859M.2.74.G08.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcagaaacctggccaggctcccaggcctccncatctatggtgctatccaaacgtgggcccaacgtggtactccccgagtcccgaaggttcaaggttcgggactagggttcggggtacttgggggaacttacggtacgtttccacgttccgtacaacccgtattccgacgccgtaaggcccttgaccgtaggttccttaggtaaacggtttactttttaggaccgtttaagtttttaacttaccgttacggttacctagtacgtaagtttaataaacgtttaaccggtccggggtacccttacccggggttacgggttaacccgggtttaccgggaaacccgttaaacggggggtaaccctaagggggttaacggtaaaacgttacccggaaaaaccggttaacgttcgggttaaccggcgttaccggacctaaccgttacggttcctttacggttcctttaaccg

SEQ ID NO: 176226 - DNA, 727 bp, Homo sapiens
  misc_feature: GYAE6OF02J1K0T.2.74.G08.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagacgctcgacacacgaccggtgctcgatttagtagctctatcagggggaggaactgctcagttaggacccagacggaaccatggaagccccagcgcagcttctcttcctctgctacctctggctcccagataccactggagaaatagtgatgacgcagtctccagccaccctgtctgtgtctccgaggggaaancgccaccctctcctgcagggccagtcagagtgttagcagcaacttgcctggtccagcagaaacctggccaggcctcccgaggtcctcctcatctagnggtcncatccaagtcgggccctacgtcggtactcccgaggcctaggttcaaggtcggacgtacggtcgggggtactggggaacttacgacggtttaccaccgttcgtacccgacctagtccgacgtccgaacggtcccgttacggcctacggttcgtaacggtaaccggtttatttttggaccgtttaagtttttaccgttacgtttacggtactaaggtaccgttaagttaaacgttaaacgttaccgtttacgggtaccgtttacccgggttagggttaacccggtttcccgggaacggtaaaccggggttaaccggtaacggggttaacggtaaacggttaaccggtaaaacggttacgttaccggggtacggtacccgttacgggtaccctaaccggtaacctttccgttacggttacccgtttaaccg

SEQ ID NO: 176227 - DNA, 683 bp, Homo sapiens
  misc_feature: GYAE6OF02JPAMG.2.74.G08.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (649)..(649): a, c, t, g, unknown or other
  misc_feature (649)..(649): n is a, c, g, or t
tcagacgctcgacacacgaccggtgctcgatttagtagctctatcagggggagggaacgtgctcagttaggacccagacggaaccatggaagccccagcgcagcttctcttcctcctgctactctggctcccagataccactggagaaatagtgatgacgcagtctccagccacctgtctgtgtctccgaggggaaacnggccacctctcctggcagggcccaggtcagtcgtgttagcagtcaacgttagcctaggtaccagcaagtaaacctggccagggtcctcccgaggcttcccnctactcgttatgggttcgactaancccgaaacgnggggtaccccaggttcgtaaccncccgtaacggccctaagggttccaggtcggacgtagggttcgggtcgtagggaatacggtattacccgtcttcctacccgtaaccaagtcccgaagtcccgtaacggtcccgttcggacgtacggttacgtagtaacggtttagtttacgtacgttagtttttaaccttagttacgtacgtacgcgttaacgttaataacgtaacgtccgtacgttccgtagttaccgtacggtaccgaacgggtaccgagggtacgtaaacgtaccggtaaatcgtacggtacggtaccgngtaccgtaccgtattcgttacggttacttaaccg

SEQ ID NO: 176228 - DNA, 567 bp, Homo sapiens
  misc_feature: GYAE6OF02FS6O7.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggctcccaggctcctcatctatggtgcatccaacgagggccactggtactcccagccctaggttccaggtggctagggtgggtctgggataggagttcacttctcaccatcagcacgcctgctagtctaggaatattttgacttagtttattactgtcagtctagttaataatacgtggtacccttcggttacggtaccgttacggaccgaacgggaccgtaagggtacggtaaacgtacgaaaaccggtacgttaggtacggacgtacggacctaccgtagtccttacgttccttaccg

SEQ ID NO: 176229 - DNA, 718 bp, Homo sapiens
  misc_feature: GYAE6OF02HVRWQ.2.74.G08.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagacgctcgacacacgaccggtgctcgatttagtagctctatcagggggaggaactgctcagttaggacccagacggaaccatggaagccccagcgcagcttctcttcctctgctactctggctcccagataccactggaagaaatagtgatgacgcagtctccagcccaccctgtctgtgtctccgaaggggaaancgccacctctcctgcagggcagtcagagtgtancagctactgctgtaccagcaagaacctggaccaggcctaccgagcctcctacatctagtggtcgactactccaacggcggacctacgtggtacctcccgagtccgtagttacgacggttcggactgggtcgggtcgtaggggtatacggtacgttacctacgttcctaccactactccgaagccgagtccgtcgcgtagttcgtaagtaacgtttgttttacgattttaacgttttacttacgtacgttacaggttaacttaaggttaaacttaaacgttccggtaccggttacccgtttaccggggttaagggttacccgggtttaccggaaaccgggtaaaaccggggttaaccgtaacgggggttaaaacggtaaacccgttaaacggaaaaacccgggttaacggttcggggttaacgggtaccctttacggaacccgtttaaacccgagttttcccggtttacgttaacctttaaccccgg

SEQ ID NO: 176230 - DNA, 787 bp, Homo sapiens
  misc_feature: GYAE6OF02JPP5T.2.74.G08.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagacgctcgacacacgaccggtgctcgatttagtagctctatcaggggaggaacgtgctcagttaggacccagacggaaccatggaagccccagcgcagcttctcttcctctgctactctggctcccagataccactggagaaatagtgatgacgcagtctccagcccaccctgtctgtcgtcctccgagggggaaacncgcccaaccctntccctgcgacgggcctaggtccaaggagttgttacgcagacctaacttagcctggtaccagcacgaaaccgtcggccgacggtcctcccgaggcctcccactactcgtagtcggtgacactcccaaggaccgggtccaggtcgtacctcccgaggcctacggttcaacggttcgggaccagggttcggggtactagggtaacgtcgtacgtttaccaccgttaccgtaccgtaccgtaagtccgaacggtcctaaccgggtccgtacgtaccgtacggttacgtaacggtaacgtttacgtttacggtacgtttaacggttttacttacggttacgtacgttaacggtacttaaacggtttaacgttaaaccgttacgtacccgggttacccgttaccggggttaccggttaacccggggttacccggtaacccggtaaacggggttaaccccggtaaggggttaaccgttaaacgggtaaacccggtaaaacggtaaccgggtttccgggtaacgtacggttaacccggtacctaaaccgtcggtttaacccgttaggtttccccttaaacgg

SEQ ID NO: 176231 - DNA, 592 bp, Homo sapiens
  misc_feature: GYAE6OF02GFNOB.2.74.G08.1.454.CMB.1.raw
  modified_base (285)..(285): a, c, t, g, unknown or other
  misc_feature (285)..(285): n is a, c, g, or t
  modified_base (424)..(424): a, c, t, g, unknown or other
  misc_feature (424)..(424): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggctcccgaggctcctnatctagtggtgcatccaacgacgggcccaacgtcggtacctccccacggcccgtaggttccaggtcggacgtaggtcgggtctaggggataggtagttcacttcctcaccatcagcagtcctgcctagtctagtaagtnttttagcttagttttacttacgtgttacagtacgtagtaattaatacgtcgtccgttacgttacggtaccggttcggaaccgaagggtaccgagggttacggaaacgtacgaaaaccggacgttacggtacggtcttacgaccgtacctagttcgttacgtccttacc

SEQ ID NO: 176232 - DNA, 652 bp, Homo sapiens
  misc_feature: GYAE6OF02JO38T.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagcccaccctctcctgcagggccagtcagagtgttagcagctaacttagcctaggtaccagcacgtaacctggccaggtcctcccgaggtcctccgtacactcgtagtggtcgactactccgaacgcgggaccctagtcggtactccccgagtccgaggttcaggtggcaggtcggtcgtggatagtacgttcaccttcgtccaccgtatcgagaccgtgccgtaggctacgttactaggtaacgtagttttacgacgttaagttttacgttacttgtactacgtactagttaacgttaacgtaccgtcgtacccgttcgtacgttaccggttaccggaccgtaacgggtaaccgtacgggtaacgtaaacggtaacccgaaacgttaccggtacgtacggtaaccgtacggtaacccgtaaccgttacgttacccggttacgttaccgttaaccg

SEQ ID NO: 176233 - DNA, 641 bp, Homo sapiens
  misc_feature: GYAE6OF02FIAF2.2.74.G08.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (458)..(458): a, c, t, g, unknown or other
  misc_feature (458)..(458): n is a, c, g, or t
  modified_base (624)..(624): a, c, t, g, unknown or other
  misc_feature (624)..(624): n is a, c, g, or t
tcagacgctcgacacacgaccggtgctcgatttagtagctctatcagggggaggaactgctcagttaggacccagaccggaaccatggaagccccagcgcagcttctcttcctcctgctactctggctcccagactaccgactggagaaactgtgatgacgcagtctccagccacctgtctgtgtctccaggggaaangccaccctctctgcaggggccagtcagngtgtagcagctaacttgcctggtaccagcagaacctgccaggcctccgaggctcctcacgtctatggtcgctactccaacgacggggtaccacgttcggtaactccccgtaaggccaaagggtttccaggttggccaggttcgggtctggggattaggtacgttacgaacctttctaccgaccacgtacgacgtacgacgtcctacgtcgacggttcttagggtaaacgttnttttacggacttacggtttaacttaacgttcggtactaggtacctacgttaaactaagttaaccgtcgggtacccttcggtacgggtacccgttcgggaacctaacgggtaccgaggtaacggtaacacgtaaacgtacgtcgttacggccgttaggaccaccgtntactacggttcttaccg

SEQ ID NO: 176234 - DNA, 647 bp, Homo sapiens
  misc_feature: GYAE6OF02H3C3T.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgcccaccctctcctgcgagggccagtcagagtgttaagcagactaacttagccgtggtaccagcaacgaaacctggaccaggacctacccgaggtcctccgtactataccgttagtcggtcgacacgtacccaaacgacgggcctaacgtcggtaacctccccgaggcccgtaggtcgaggtcggactagggttggtcgtagggaagttagacgttacgtactccgtacaaccctagtcgagacgagtcctacgctagtcgtagaacgttagtttcgacttaagttttactagtgtacgagacgtaagttaaactaacgttaacgtcggtaccgtaccgggttagtaccgggttaccgaacgaaaccgggacgtaagggttacgaaacgtaccgaaaaccgtgttacgacggtacgacgacccgtacacgtttcgtactcgttaccg

SEQ ID NO: 176235 - DNA, 787 bp, Homo sapiens
  misc_feature: GYAE6OF02JUDZI.2.74.G08.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (775)..(775): a, c, t, g, unknown or other
  misc_feature (775)..(775): n is a, c, g, or t
tcagacgctcgacacacgaccggtgctcgatttagtagctctatcagggggaggaactgctcagttaggacccagacggaaccatggaagccccagcgcagcttctcttcctctgctactctggctcccagataccactggagaaatagtgatgacgctagtctccagccaccctgtctgtcgtctccgagggaaatacgcccaccctntccgtgccagggccaggtcaagngtgtagcagctaacttgcctaggtaccagcacgaaacctcggcctacggcctacccgagggtcctcccgtactacgttacctaacgtcgggttcacctactacccgtaaccggacgggtccctacgtacgggttaacctaccccgacggtaccctagggtttaccgaacgggttacgggcccgttaaggggttcggggttaccgttacgggggtaacttaacggggtacggtttaccctacgttaccggttaccaaacccggttactaccggtaacgcctaaccgggtaccgtttggacccgtaggttccgtaaggtaaggtttacggttttacgccgttttaaagtttaccgtttaacgtcggttaccgtagaccgttaaagttaacgtaaacgttaccgttacgggtcccgtaccgggttacggttccggttaaccgggtaccggaacggggttaacccgagggtaacggttaaacgaacccggtaaaggtaacggttaccggtaggtaccttacggaccgtaaaccgtcgttaacggttnttaccgtttacc

SEQ ID NO: 176236 - DNA, 557 bp, Homo sapiens
  misc_feature: GYAE6OF02IYGDH.2.74.G08.1.454.CMB.1.raw
  modified_base (197)..(197): a, c, t, g, unknown or other
  misc_feature (197)..(197): n is a, c, g, or t
  modified_base (408)..(408): a, c, t, g, unknown or other
  misc_feature (408)..(408): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcaagaacctggccaggcctcccaggctcctcactctatggtgcatccaacgagggccacgtcggtactcccgagcctaggttcaggtggcgtaggtgggtctgggatagtacttcactctacaccatcgagcagcctagctagtcgtagaattntttagacttaagttttactactgtcagactaagtataactacgtcgtccttcggtacgtaccgttcggaacgtaacgggaacgtagggtacgaaacgtcgtaaacgacgtggtacgcgtacgacctacgagtcgttacgtaccgttacg

SEQ ID NO: 176237 - DNA, 691 bp, Homo sapiens
  misc_feature: GYAE6OF02HC68V.2.74.G08.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcgacgggccagtcagagtgttagcagctaacgtgcctggtaccagcaagaaacctggccaggcctcccgacggtcctccctnacttctagtgggtcgaccagtacccgaacgacgggccctaagttcgggtactccccgaaggtcccgtaaggttccgaggtcggacgtagggttcggggttactaggggaagttaggtacgttcctaaccgttccgtacctaaccgtatacccgaacgccgacggtccccgttagccggttaacgttcgttaaggtaaacggttttacgttttacggacgtttaacgttttttacttacgtcgttacgtacgtacttaagttaactaacgttacgtccggttaccgtcgggttacggtacggttccggaaccggaagggtaccgtaagggtacgtaaacgtcggaaacgtacgtcggtacggtcgttacgacctacgacgttcgttactccgtacc

SEQ ID NO: 176238 - DNA, 792 bp, Homo sapiens
  misc_feature: GYAE6OF02IAXXJ.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggacgaaatagtgatgacgcagtctccacgccaccctgtctgtgtctccgaaggggaagacgccaccctcctcctgcgacgggccagtacgagtacggttggttacgctacgactaaccttaggcccgtggtaacccaggtaccaacggaaaccccgttcgggaccgaccggtaccgtaccccgaggtcccttcccgtactacttcgtagtcgggtactccgtaacctacccgtaacggacccgggtaccctaacggttcggtacccttaccccgtaacggacccgttacgggttaccgacggttacgggtaccggtacgggttacgggttccggtagggttaagtacggttacttacgtacttccgaaccctaccgtaactcgtaacgcctacggcccgtaggacttacggtcgtaaggtaacgtttagttttacgacgtttacgtttagttacgtacgttctaaggaccgtaagtaattaaacggttaacgtacgggtaaaccgtaacggtaaccggtttacccgaacgggtaacgtaaccgggtaagggttacgaaaccgtaacggaaaccgtaccggttaacggacgggtccctacggtaccctaaccggtaacgtttaccgtaccggtttaccgttacgttaacccg

SEQ ID NO: 176239 - DNA, 765 bp, Homo sapiens
  misc_feature: GYAE6OF02IR1HB.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagcccaccctctcctgcagggccagtcagagtgttagcagcaacttagcctggtaccagcaagaacctggccaggcctcccgaggcctcctcatcctagtcggtagccactacccgaaacgacggggccctaacgtcggggttactccccgaggtcccgtaaggttccgaggtcgggccgtagggttcgggggttacgtaggggtaattaggtacgtttccacgttcctacgaccctagtaccgacggtccgaacgtccccgtgaccgtacggttccgtaaggtaagtttacgttttacggaccgtttaagttttaacgtttacgtacggttacaggttaccgtaagttaaacgtttaaacgttaaccgtcgggttaccccgttaccggggttagggtttaacccgggttacccgggaaacccgggtaaaccggggtaaccggtaaacgggtaagggtaaaaaccgttaacccgggaaaaaccgttaacggggttaccggttacgggtacccgttaggaacccccgttaaccgtaccggtttaccgtttccggttaccctttaacccgg

SEQ ID NO: 176240 - DNA, 791 bp, Homo sapiens
  misc_feature: GYAE6OF02IKFT4.2.74.G08.1.454.CMB.1.raw
  modified_base (378)..(378): a, c, t, g, unknown or other
  misc_feature (378)..(378): n is a, c, g, or t
tcagacgctcgacacacgaccggtgctcgatttagtagctctatcagggggaggaacgtgctcagttaggacccagacggaaccatggaagccccagcgcagcttctcttcctctgctactctggctcccagataccactggagaaatagtgatgacgcagtctccagccctacccgtgtctgtcgtcctaccggaaggggaaacgcgtcccacccttctacctggcagggccagttcaggtagtgttacgcagctaaacgttgccgtggtaccaggaccaagaaaccgtcggcaacggcctccgaacggcccttcctacgaatcgttaagtggtccgaccaacccgtaacgacggccgtacgtacgtacggtacccnccggtacgagttcgagtcggaccgtaggttcgggacggttcgggaaagttacggtacgttcgtacctaccgtcctaaccgaagtcgtaaccacgtcgtaacccgtgtacggaaccttgtaccggttaaagtacgttttcgtaccgttaagttttaacgtttaccgtacgttacgttaacgaagttaaccgggtaaattaaacgtttaccggtaaccgttacccggggttaaccgttaccgggttaaccgggtttacggtaaacccgggttaaccgggaaaaccgggttcggggtaaaacgggttaacgttaaacccggtaaaaggtaacccggttaagggttaccggttaaccggtacgttaccgaacccggtttgtaacccggttttcggttaaccgttaccgttaacccgg

SEQ ID NO: 176241 - DNA, 720 bp, Homo sapiens
  misc_feature: GYAE6OF02G2WUP.2.74.G08.1.454.CMB.1.raw
  modified_base (197)..(197): a, c, t, g, unknown or other
  misc_feature (197)..(197): n is a, c, g, or t
  modified_base (468)..(468): a, c, t, g, unknown or other
  misc_feature (468)..(468): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcacgggccagtcagagtgttagcagcaacttgcctggtaccaggcaagaaacctggaccaggcctacccgaggtccttcctcacttctagttggtcgactactcccgaacgacgggcctaacgtcggtaactccccaaggtccgtaggttcaggttcggacgtagggttcggggtactggggattaggtacgttaccacgttcacgaccatcgacgtaccacggtccgtgaccgtagttacgtaggtaaagtttntttcggtaacgttttagttttaacgttacgttggtactagttaacgaacttaagttaaacgttacgtaccgggtacccgtttacgggttcggttaacccgggtttaaccggaacccgggttaaaacggggtacccgaaagggggttaacggtaaaaccgtaacgttaaaaaccccggtacggttacgggttaccggtacgttaacgggtacctaacccgttaaccttccggtttacgttacccctttaaccg

SEQ ID NO: 176242 - DNA, 590 bp, Homo sapiens
  misc_feature: GYAE6OF02JSW6S.2.74.G08.1.454.CMB.1.raw
  modified_base (198)..(198): a, c, t, g, unknown or other
  misc_feature (198)..(198): n is a, c, g, or t
  modified_base (314)..(314): a, c, t, g, unknown or other
  misc_feature (314)..(314): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (553)..(553): a, c, t, g, unknown or other
  misc_feature (553)..(553): n is a, c, g, or t
tcagacgctcgacacacgaccggtgctcgatttagtagctctatcaggggaggaactgctcagttaggacccagacggaaccatggaagccccagcgcagcttctcttcctcctgctactctggctcccagactaccactggagaaatagtgatgacgcagtctccagcccacctgtctgtgtctaccgaggggaacngcccaccctctcctgccagggccagtcagagtcgttagcctagcaacttagccgttaggtacccagccaagaaacccgtggcccaggtcctccccgaggcctacctcaatccgtancggtgccatcccaaacgacgggccctaagttcgggaactccccgaagccctagggttcaacggttggcctagtcgggtactgggactggagttcacttccnaacctnacctagcacgctagctagtcgtacgtagtacttttgactttagtttacttacgttgtacctgtactagtaacttaactagtcgtccgtcgtgtaccgtcgacgacgtagagtacggaacgtaacaacgtacncggtacggacgtcgacgtccacgtcgttacgtcttac

SEQ ID NO: 176243 - DNA, 785 bp, Homo sapiens
  misc_feature: GYAE6OF02GM9UG.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaagcgccaccctctcctgcagggccagtcagtagtgttagcagacaacttagccgtaggtaaccagacaacgaaaccgtggaccgaggcctaccccgaggccttacctacgtactacgtaagtcgggtacgacctaacgtacccgaaaacggaccggggtaccctaacgttacgggtaacttacccccgaaggtccccgtaaagggtttccaacggttggaccgtaaggggttcgggttacgtaggggaattaggtacgtttacccaacgttcctaccaacccgtagtaccgacgtaccgtaacggtcccgttaggaacccgtaagttaccgttaaggttaaaacggttttacgtttttaccggacttttaaaggtttttaactttaaccggttaggttactaaacggtacgttaaagttaaacgttaaaacgttaccggttcggtacccgttacgggttacgggtaacccggttacggaaccggtaacgggtaacgtaagggtaacgtaaaacgtaccgtaaaacggtaacgttcgggtaacgtaccgtacggaacctaaccgtagtttccggttactaccgttaaccg

SEQ ID NO: 176244 - DNA, 684 bp, Homo sapiens
  misc_feature: GYAE6OF02I51PZ.2.74.G08.1.454.CMB.1.raw
  modified_base (160)..(160): a, c, t, g, unknown or other
  misc_feature (160)..(160): n is a, c, g, or t
  modified_base (287)..(287): a, c, t, g, unknown or other
  misc_feature (287)..(287): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagactaccactggagaaatagtgatgacgnagtctccgagccacctgtctgtgtctccgaggggaaacagccacctctcctgccagggtccagtcagagtcgtaagcagacaacttagcctggtaccagacagaaaccgtggcctaggcctacccgnggaccttcctacgacttctagtcggtgactagtccaaacgacgggtccaacgtcgtactcccgaagccctaagggttcaaggtcggacgtaggttgggactaggggaactaggaagtttcacgttacctaccaaccgtagtaccaggacccgtacgtcccgtagtacgtaacgttaccgtaaggtaaagtttagttttacgaccgttaaagtttttaacttacggtacgttacggtacgtacgtaaggtttaaactaaacgggttacgtacgtaaaccgtaaaggtaccgtttaccgggaaaccgttaaacgggaccgttaagggtacggaaactacggtaaaacgtacgtggtacggtactacgactaccgattcggttaccgttctacgtaaccg

SEQ ID NO: 176245 - DNA, 675 bp, Homo sapiens
  misc_feature: GYAE6OF02G5HNH.2.74.G08.1.454.CMB.1.raw
  modified_base (198)..(198): a, c, t, g, unknown or other
  misc_feature (198)..(198): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcgagggccagtcagtagtgttagcagctaacttgcctggtaccagcagaacctggccnggctccaggtctccncactctagtggtcncactaccaacgcgggcctagtcggtactccgacgtccgtaggttcgaggttcggacgtaggttcggggtacgtaggggtacttacggtacgtttaccgaccttcgtacccgtaacctacgtaccgacggtaccacggtacccgtcggacgttaacgttacgtaggttaacgttacgttttcgacgtttaaggtttacttacgttcgtacgtacgtactaagttaacgttaacgttaccgtcggttaccggttacggttaccgggttacggttaacccggaccggtaacgggtaccgtagggtaacgtaacgtaaccgaaacggttacggtggtacgtaccgtacggacctactacgttcttacgttccttaacg

SEQ ID NO: 176246 - DNA, 831 bp, Homo sapiens
  misc_feature: GYAE6OF02GCSW9.2.74.G08.1.454.CMB.1.raw
  modified_base (145)..(145): a, c, t, g, unknown or other
  misc_feature (145)..(145): n is a, c, g, or t
tcagacgctcgacacacgaccggtgctcgatttagtagctctatcagggggaggaacgtgctcagttaggacccagacggaaccatggaagcccagcgcagcttctcttcctcctgctactctggctcccagactaccactgganaaatagtagatgacgacacgtctaccacgccacccgttgtctgtcgtctaccgaggggaaagacgccgacccttcgtccgtcgacgtacgggccacggtcagtacgttagttagccgaagacctaacgttacgtccgtacgggtaccaggaccaacgtaaacccgtgggacccctacgggcctaaccccgagggtcccttaccctacgactttaccgttaacggtcgggttctaacctaaccgttaaaccccggaaacggtaccggggtaacccctttacgggttaccgttaaccccggtaccccgaggttaccccggttaaggttttccgaaaccggtcgggtacgtaggttccggggttacgtggggtaaaactttaggtaaaccggttcctaacccgtccctaacgaacccgtactcgaacggacctacgtaccgtacggacttacggttaactggttaaacggtacgtttacggttctttaaactttcgttaacgttacgtacgtaggtaaccttacggtaaactttaacgtaacctaccgggtactaccgggttaggacccggtttacggaccggtaacgggaacgttacggtaaacgtaacgtaaaccgtaaacggtaccgtaacgtggtacccgtacggacccgttaacaccggtttctaccgggtttacctaacccgg

SEQ ID NO: 176247 - DNA, 757 bp, Homo sapiens
  misc_feature: GYAE6OF02GKDIK.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagctaacttagcctggtacccagcaagaaacctggaccaggcctcccaggcctcctcatctagtggtcgactactcccaacgcgggccctacgtcggtactaccccgaggccctagggtttccaaggttcggcgtagggttcggggtcgttaggggaattaggtacgtttaccaccttaccgtaccaaccctaagttccgaacggcctaacggcccgttaggacccgtaggttaccgttaaggtaaacgtttacgtttttcggaacttttaacggtttttaactttacgttacggttaacgtacggtaaccttaaaggtttaaacgttaaaacgtttaccgttacggggttaccccgttaccggggttacggttaaccccggtttacgggaaaaccccggtaaagggggtaacccgtaagggggttacggtaaaaaccgtaccggtaaaaaaccggtacggttacgggttacggaaccgttacggacctaacccgtactttccggttacgtttaccccttacg

SEQ ID NO: 176248 - DNA, 670 bp, Homo sapiens
  misc_feature: GYAE6OF02IH2OE.2.74.G08.1.454.CMB.1.raw
  modified_base (464)..(464): a, c, t, g, unknown or other
  misc_feature (464)..(464): n is a, c, g, or t
  modified_base (516)..(516): a, c, t, g, unknown or other
  misc_feature (516)..(516): n is a, c, g, or t
  modified_base (626)..(626): a, c, t, g, unknown or other
  misc_feature (626)..(626): n is a, c, g, or t
  modified_base (637)..(637): a, c, t, g, unknown or other
  misc_feature (637)..(637): n is a, c, g, or t
  modified_base (647)..(647): a, c, t, g, unknown or other
  misc_feature (647)..(647): n is a, c, g, or t
  modified_base (657)..(657): a, c, t, g, unknown or other
  misc_feature (657)..(657): n is a, c, g, or t
tcagacgctcgacacacgaccggtgctcgatttagtagctctatcagggggaggaactgctcagttaggacccagacggaaccatggaagccccagcgcagcttctcttcctctgctactctggctcccagataccactggagaaatagtgatgacgctagtcctaccagccctaccctgttctgttcgtacctaccggaaggggaaacacgccctaaccgtttcctccgtcggaccgaacggggtccaggttaccgaaggtaggtttcggtaacgacctaggacctaaacgttcggacccgttaggtaacccaggacgaaaccgtaaaccgtcgggaccacggtccctacccgacggtcccttccgtacctattaccgttagttcgggtacgacctaaccgtaaccgaaccggaccgggtaccctaagttacggtacctacccgacggtccgtaacggttcgngtacggacgtggttcgggtcgtagggacgtagtacgtcctactccacactanacgacgcgtacgctgactagtacgagtagttctttgaactttagtttactgtcgtatacagttataactaataccgtcgtacgtgtacgccgtagaccgagtacgagtanacgtaacacgngtgacgtacncgtaccactntacgtcgtatccg

SEQ ID NO: 176249 - DNA, 715 bp, Homo sapiens
  misc_feature: GYAE6OF02FN981.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctccgtgcgacgggccagtcagtagtgttagcagctaacgttagcctaggaccagcaagaacctggaccaggcctcccgaggtcctccgtacattcgtagtggtcacctactacccgaaacggtccgggtaccctacggttacggttaaccaccccgtaaggacccgttaaggggtttcccgaacgggttacggggacgttaaggggttcgggggttacgtaccgggggtaaactttagggtaacgtttacccgtaacttccgtaccaacccgtagtaccgacgtacgaacgtccgtacgactacggttacgtaagtaacgttgttttacggtacgttaagtttactttacgtgtacacgtataacgttaagtaagtacggtacgtaacggtaacgtacggttaccggacggaacgggtaccgtaagggtacgtaaacgtaaccgtaaacgtacggttaggtaccgtacgtacggacctacgtacgttcgtacgtttactaccgttaccg

SEQ ID NO: 176250 - DNA, 663 bp, Homo sapiens
  misc_feature: GYAE6OF02H96DW.2.74.G08.1.454.CMB.1.raw
  modified_base (196)..(196): a, c, t, g, unknown or other
  misc_feature (196)..(196): n is a, c, g, or t
tcagacgctcgacacacgaccggtgctcgatttagtagctctatcagggggaggaactgctcagttaggacccagacggaaccatggaagccccagcgcagcttctcttcctcctgctactctggcttccagataccactggagaaatagtgatgacgcagtctccagcccaccctgtctgtgtctcgaggggaancgccacctctctgcgagggccagtcagagtgttacgcgagactaacttcgccgttcggtaaccagcaacgaaaccgtggaccacggcctccgaacggtccttacctcgtacttacgtagttcggtcgactacgtaccgaacggacgggaccctagttacggtactacccgagtaccgtaggttcgaaggtcggacgtagggtcgggtcgtagggtaactaaggtcgtttaaccacgttaccgtccaactacgtccgaagtccgtacgtccgtgaccgtagttcgtacggtaaagtttgtttacgtacgtttaagttttacttagtctacgagtacgttaagttaagtaacttaccgtcggtaccgttcggtacgtaccggttacggaacggttaacggaacgtaggttaagaccgtaacgaacgttgtacgacgtacgcgacctacgtgttacgttcgtaccgttcg

SEQ ID NO: 176251 - DNA, 774 bp, Homo sapiens
  misc_feature: GYAE6OF02JE831.2.74.G08.1.454.CMB.1.raw
  modified_base (145)..(145): a, c, t, g, unknown or other
  misc_feature (145)..(145): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaanaaataggtgatgacgctagtctccagcccacccttgtcttgtgttccgtaccgagggggaaacacgacccaccgtctacctggccgagggcccagtccgagaggttgtagacacgtacaacgttacgcgttacggtaccaagacaacggtaacctcggaccgacggtccctacccggtaggtccccttacccgtattaccgttacttacggagggtttccgaaccttacgaacccgtaacgacgggtacctacggttcgtacctaccaacggtaccgtagggtttacacggtgaccggtttagggtccgggtaaggtcggtaacgtaggttacctacgtacttccgactacccgtaggttccacgaccgtacgtacgtccggtacgtaacgttggtaacgtaaagtttacgtttaaccggttcgtttaaagttttcgttacgtacggttacaggttaaccgtaacgtttaaaacgttaacgtaccggttccggtaacccgtttcggacgggtttaccgaaacggttccggaaaacgggttacgtaaggggtaaccttaacggtaaacgtaaccggttaggttacgcggtaagtacccgtacgaccctaaggttcgttcgttacgttccg

SEQ ID NO: 176252 - DNA, 796 bp, Homo sapiens
  misc_feature: GYAE6OF02FT95F.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggcctcccagataccactggagaaatagtgatgacgcagtctccagccaccctgtctgtgtctccgaggggaancgccaccctctcctgcgacgggccagtcagagtgttagcagacctaacgttacgcctacggtaaccagaccgaacggtaaacccgtggacccgtacggtaccctacccggacggtcccttacccgtacgtacttacgtacggtacggtacgtcctaacgtacccaaccggaacgggtccctaacggttacggttaacctcccggaacggtaccggttagggttaaccctaggtacgggcgtaagggttcgggtacgtaggggtatacgggtacgtttccgaccgtacctaaccgtaccgtagtccgaacgtccgtacggtaccttcggaaccgttacgtacccggttaggtaaagtttccgttacggttaaccgtttaacggttttattacggtaccgttacgggaacttacggttaaaacgttacgttaaaccgttaacggtacccggttaccgttaaccgggttaccgttaccggtacccgggtaaacccggtacggggtaaccggtaacggtaaccggtaaagtaccccgtaaaacggtacgtcggtacggtctaacggtaccctaacgttacgttcgttacggttaccttaccgg

SEQ ID NO: 176253 - DNA, 1104 bp, Homo sapiens
  misc_feature: GYAE6OF02IKUBJ.2.74.G08.1.454.CMB.1.raw
  modified_base (197)..(197): a, c, t, g, unknown or other
  misc_feature (197)..(197): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaanacgcccacctctcctgcagggccagtcagtagtgttagcagactaacgtcgcctacggtaccagtacaaggtaaaccgtcggaccgacggtcctcccgaggtccctacccgtactacgttccgttagttcggggtacgtaacctaccgttaaccccgaaaaccggtaccggggtaacccctaacgggttaccggggttaaccttaaccccccggtaacggtacccccggtttaaagggggttttacccggtaacggggttaccggggtaccggtttaaagggggtttcccgggggggtttaacccgggtttaggggggggtttaaaacttttaacccgggggtttaaccggttttacccccgtaaaccccgggttttaaccctttaacccccggttaaaaccccggtactttaaccccgggtaaaccgggtaccccgttaaaccggttaccccggttacgggtaaccccggtttaacgggtttaaccgggttaaagggttaaaacccggtttttaacgggttttttccggtaaccggttttaaaccgttttttttaaacggtttaccggttttaccggttaaccggtttaaacggtaaccggtttaaacggtttaaaaaccgtttaaaaccggttttaacccgggtttacccggggtttaacccccggggttttaccgggggttaacccggggttttaaaccggggtttaaaccccccgggggtaaacccgggttaaaaacccgggggttaacccgggtttaaaacggggttaaccgggttaaaaaccgtaaacccgggttaaaaaccgggtttacccggttaacggggttacccggtaaaccggttacgaccccggtttaacgttaaacccggtttccgtttaccggtttacccgttaaaccccgg

SEQ ID NO: 176254 - DNA, 662 bp, Homo sapiens
  misc_feature: GYAE6OF02G3MF7.2.74.G08.1.454.CMB.1.raw
  modified_base (518)..(518): a, c, t, g, unknown or other
  misc_feature (518)..(518): n is a, c, g, or t
  modified_base (635)..(635): a, c, t, g, unknown or other
  misc_feature (635)..(635): n is a, c, g, or t
  modified_base (658)..(658): a, c, t, g, unknown or other
  misc_feature (658)..(658): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctacgaggggaaagacgcccaccctctccgtcgcgacgggccagtcgagtagtgttacgacacgaccaacttacgccttggtaaccacgccaaggaaacccgtggacccgaacggtccctaccccgaacgggtccttaccctaccgtaacttcccgttaacggttcgggtcgtaacctacgtaacccgaaaccggtacgggaccctaacggttcggttaccttccccgacgtccggtaacggttcacggtggtacgtagggttcggtcggtagggtacgtacggtacgttccgtactctaaccgtactacgtaccagccagcctcgacgtcgttnaggttaacttagtttgacggtttaacgttttactacgttgactagtagtataatacgtacgcgttaccgtcggtaccgttggtaccgacgagtacgagtagaactaacgaagtacgngtcgtcacacgtcactcgtactntccg

SEQ ID NO: 176255 - DNA, 631 bp, Homo sapiens
  misc_feature: GYAE6OF02ITZFK.2.74.G08.1.454.CMB.1.raw
  modified_base (198)..(198): a, c, t, g, unknown or other
  misc_feature (198)..(198): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagactaccactggagaaatagtgatgacgcagtctccagccaccctgtctgtgtctccgaggggaaanacggcccaccctctcctgcgagggcccagtcagtagtgtacgcagtacaattcgctcggtacagccaagtaacctggaccagcctcccgaggcctcctctaatcgtagtcggtagccacgtaccaacgtacgggacctacgttacggtacgtccctaggccctaggttccaggtcgacggtagtcggggtgtagggacgttagtaggttacctacgtccgtaacgacctaagtaccgacgacgtaccggctcggactacgtcgtagtaacgttagtttacgtaccttaagtttacgtttacgtggtactacgtacgtaagtaagtaacgttacgtcgtaccgtccgtacgtaccggttcgaacgacggtacgagtagaacgtcgtaaagacgtgtcgacgttacgacctaccgtatcggttactccgttaacg

SEQ ID NO: 176256 - DNA, 922 bp, Homo sapiens
  misc_feature: GYAE6OF02I16F5.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggcctcccagactaccacgtggaagaaatagtgatgacgcagtcctaccacgcccacctgtctggtgtcctaccggaaggggaaactcgacccctaaccctccgtccgtgaccgacgggaccaggtcaaggtagttagttacgcgtaacgaccgtaaacgttacgtaccgtacggtaaccacgaccgaaacggaaaccggtccggacctaaggtcccctaacccggacggtacccttacccgtaactacgtacccggttaacggtacggtaccgtaccgtaaccgtaacccggaaaacccgggtccggggaaccccttaacgggttaccggggtttaaacccctaacccccggtaggtaaaccccggttaagggtttaccgtaaacggggttccgggaacggtttacggggtttaccggggttaaccggggttaggggtaaaacggtttaccgggtaaccgttttacccgaacccgttttccctaaacccgaaacccggtttacgtaaccggaacggtaccgtacccggttacgtaccggtaccggtacgttaacggtaacgggtaacgtttaacgtttacgttacgtttaacgtttacggttacgtacgttacgtaacgtacgtaaacgttaacttaaaccgtacggtaccggttaccgttaccggtacggttaaccggtaccggtaaaccggaaccgggttaagtaacgggtaaacggtaaacggtaaccgtaaacggtacggtaggaccggtactacggtaacctaccgtacttacgttaccggttaccttaaccg

SEQ ID NO: 176257 - DNA, 813 bp, Homo sapiens
  misc_feature: GYAE6OF02GB3HQ.2.74.G08.1.454.CMB.1.raw
  modified_base (262)..(262): a, c, t, g, unknown or other
  misc_feature (262)..(262): n is a, c, g, or t
  modified_base (341)..(341): a, c, t, g, unknown or other
  misc_feature (341)..(341): n is a, c, g, or t
  modified_base (444)..(444): a, c, t, g, unknown or other
  misc_feature (444)..(444): n is a, c, g, or t
tcagacgctcgacacacgaccggtgctcgatttagtagctctatcagggggaggaactgctcagttaggacccagacggaaccatggaagcccagcgcagcttctcttcctctgctactcgtggcctccagactaccatggaagtaaatgtagactgaacgcctaagtccaccacgtcccacccgttgtccttggtactccgtaaccggaaggggaaatacccggacccctacccgttcttcccaggaccggacggtacccngttaaccgaggtagtttacggaacgcgtaacgtacttaaaccgtcggtacctcgggaaccacggacaacgttaaaccgnggtccgaacgtccgtccggacgtaccgttacctagaccttcgttaacgttcgacgacctaaccgtaccgaaaccggttacggacctaacggtttcggtaaccnccggtaacgtaccggtgttaaccggtaacggtagggacctttacggggttcggaacggtacgggtaggttaacgtaccggtttaactaaccccttagtttaacccgtacgtaaacgtaccgtaacccgtaccgtacgtaccggtaacgtcgtacgtagtacgttaacgtagttacgtaacttacgtttaacgtacgtattacgaagtacttagttaaatacgttaacgtcgttaaccgtacgtaccgggttaccgttacgtaaccggaagtaacccgggtaagaacggttaaaccggtaaacgtaacggtaccgttaggtaccgtcgaaccgttccgtaacggttcgttaacgttccgtagtttaaccc

SEQ ID NO: 176258 - DNA, 776 bp, Homo sapiens
  misc_feature: GYAE6OF02HYBTM.2.74.G08.1.454.CMB.1.raw
tcagacgctcgacacacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaagcgcccaccctctccgtgcgacgggccagtcagagttgttagcagcctaacttacgccgtaggtaccagtacgaacgaaaccgtcggaccaggccctacccgaggtccttccctacgtacttccgtagtcgggtacgacgtaacgtacccgaaaccgacggggtaccctaccggttcgggtaacctcccccgtaaggtccccggttaagggttccgaagggttcgggtaccgtaggggttcggggtcggtaggggtaacttaacgggtacgtttaccaccttccgtaccgaaccgtacgttaccgacggtaccacgtcccgttaggccgttaacgtcgttaggtaaagttttcgttttacgtacgtttaaggttttaaccgtcgtttacgttacgtacggtaacgttaagttaacgtttaacgttaccggtcgggttacccgttaccgggttacggttaccggttacgggaacccgttaaacggggaccgtaaggggtaaccgtaacgtaaccggaacggttaacggtcgggttaaccgtcgttacgacccgtaaccgttagtcgttaccgttacgttaccg

SEQ ID NO: 176259 - DNA, 742 bp, Homo sapiens
  misc_feature: GYAE6OF02GK9GH.2.74.G08.1.454.CMB.1.raw
  modified_base (165)..(165): a, c, t, g, unknown or other
  misc_feature (165)..(165): n is a, c, g, or t
  modified_base (170)..(170): a, c, t, g, unknown or other
  misc_feature (170)..(170): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (384)..(384): a, c, t, g, unknown or other
  misc_feature (384)..(384): n is a, c, g, or t
tcagacgctcgacacacgaccggtgctcgatttagtagctctatcagggggaggaactgctcagttaggacccagacggaaccatggaagccccagcgcagcttctcttcctcctgctactctggctcccagataccactggaagaaatgtgatgacgcagtccncgacnccctactgtcgtgtcgtcacggaagggaacgccaccctacctcctcgnggaccggacggactagtacgagttaggtacgnagtacgaactacgtcgcgtacacgnaacgaacgacggcgcgacgtcccgcgtcgtcctcacgtctagtaggtcgacacctaccgaaccgacggaccgtcgacgttccgacccgacctacggtaccggttaacgnggtcggtacgacggtgggtcggtagggtgtaacgtacggttacgtctaccgtcctaacgactaacggcgacgtactaccgtcgacgtagtacggttagtaacggttacgtttagttacgttaagttttaacgtttaccgttcgttacgtacgtaaggtacttaaacgttaaaacgttaaccggttccggttaacccggttccggttaaccggtaccggggggttacccgtaaccgggtaaacgggtacccggggtaaagttaccgggaaacttacggtaaacccggtaaggtacgggtttacgggacgtaccgaccggttaacctccggttaacgtttccggttcctcccggttaacg

SEQ ID NO: 176260 - DNA, 841 bp, Homo sapiens
  misc_feature: GYAE6OF02HLGA1.2.74.G08.1.454.CMB.1.raw
  modified_base (209)..(209): a, c, t, g, unknown or other
  misc_feature (209)..(209): n is a, c, g, or t
tcagacgctcgacacacgaccggtgctcgatttagtagctctatcagggggaggaactgctcagttaggaccccagacggaaccatggaagcccccagcgcagcttctcttcctcctgctactctggcctcccagataccatggagaatgtgatgacgcagtctccagcccaccctgtctgtgtctcgagggaagcgccaccctctccngcgagggccagtcagtgtgttacgccaagacctaacgttacgcgttacggtaccagtacaacgtaacccgtcggaccgacggtcctaccccgacggtcccttcccgtactactttacgtacgttcgggtacgacctaccgttaacccgaaccggtaccggggacccctacggtttaaccgggtaacccgtccccgaaccgttaccggttaccggtttacggaacggtcggggtccgttaaggggtccgggggtttacggtttaacgggaagttacggttaccgttacccgtaaccttttcccggaccgtacccgtttacgacgtaaccgccgtacccgttccgtaacggccgttacgtacggttaggtaacggtttcgtttaggttaacttttacggttttactttcggttaacgtacgttagtaacgttaacgttaaacttaacggtaccgttcgttccccggttaagggtttacccgggttaaccgggttacccgggtaaacgggaaccgggttaaccgtaaggggttaaccgttaaacggtaaccggtaaaccgtaacggttaaccggtaccgggttacctacggtaccctacggtttacccgttccgtttacggtttccccgttaccg

SEQ ID NO: 176261 - DNA, 866 bp, Homo sapiens
  misc_feature: GYAE6OF02IXY2C.2.74.G08.1.454.CMB.1.raw
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
tcagacgctcgacacacgaccggtgctcgatttagtagctctatcagggggaggaactgctcagttaggacccagacggaaccatggaagccccagcgcagcttctcttcctcctgctactctggctccagataccacgtggagaaatagtgatgacgcagtctcagcctacctgtctgtcgtctccgaaggggaancgccacccgtctccgngacgacgggccagtcgagtagtgttacgcagctaacgtcgtcctaggtacacgacaacgaaccgtcggaccgacggcctacccgacggtccttaccctcgtactttaccgttaacggtcgggttacgtacctaaccgttaacccgaaaccgggtacggggtaaccccttaacgggtttaacggtacccgttacccccggaacgggttacccgttaaacggtttccggaagggttccgggaacgggtttacggggttacggggttcgggtaaacgggttacggtttaaacggtaccgttttaacccgaacccggtttacctaacccgtaacccgtaagttccgtaaccggaccgttaacccggtccgttaacggtaccgtaacgttacgttaaagggttaacttttacggttttaactacggttttaaacgtttttaccgttacgtttaacggttaaccgtacggtaaaccgttaagttaaacttaaaccgttaccggttcccgggttacggtaccgggttacgggttaccggtaccggaaacggtaaccgggttaacgaacgggttaaccgaacggttaaaccaacgggttacggtaccggtaggtaccgtacgtaaccgttccgtaccgttttcgttaccggttactacccg

SEQ ID NO: 176262 - DNA, 553 bp, Homo sapiens
  misc_feature: GYAE6OF01A6CWP.17.43.D10.1.454.CMB.1.raw
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccaccagggccgctggtgtccccagccagattcgaggggcaggtgggtctgggacagagttcactctcacatcagcagcctgcagtctagaagtattttggactagtttatactgtcagtctactataataacgtcgggacccccggggggtagttccgggaccgaacgggaccgaagggtacggagtacgtacgaaaacggtacgtaggtagggctaggaccaccgtattccttaggttccttcgtagttccccg

SEQ ID NO: 176263 - DNA, 583 bp, Homo sapiens
  misc_feature: GYAE6OF01DNMUJ.17.43.D10.1.454.CMB.1.raw
  modified_base (418)..(418): a, c, t, g, unknown or other
  misc_feature (418)..(418): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccgaggggacagccaccctctcctgcagggccagtcagagtgtgagcagcaacttagcctggtatcagcaagaaacctggccaggctcccgaggcctcctcatctatggtcgccttcccaccgagggcccgcgttggtcgtcccagccagtattcgagggcagggtgggtctggggacaggtacgttcacgttctacgaccatcacgcacgcctgacagttctagtaagttnttttagctagttttattactgtactagtactacttaataacgtaacggtccggggacccccggggggtacgttccgggaccgtaacgggaccgaagggtcggaggtataacgaaacgtaacgtggtaggtcgtcgacaccgtagtctagttcttcgtcgttcccg

SEQ ID NO: 176264 - DNA, 851 bp, Homo sapiens
  misc_feature: GYAE6OF01CTX4D.17.43.D10.1.454.CMB.1.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagccacctctcctgcagggccagtcagagtgtgagcagcaacttgcctggtatcagcagaaacctggccaggcctcccgaggcctcctcattctatggtcnccttcccgaccgagggcccncgttgggtcgtccccaggcccaggtacgttccggaagggggtctaaggggttcggggtaccgtaggggggaacctaagggtacgtttccgaaccgtttcccgttacccgaaaccccgtaagttacccgaaacggtcccgaacggtccccgttacgggacccgttaacgggttacccgtttaagggtaaaacggtttaacgtttttttacggaacccgttttaaagggtttttttaaactttaaccggttaggtttaacctaacggttaacccttaaaccgtttaaacgtttaaaaccggttaaacccggggttaccccgggggggtaaccccccccgggggggggttaacgttttaccccgggggaacccggtaaaaccggggggtaaccccggtaaaagggggttacgggaaacggtaaaccggttaaacccggtaaaaaccgggtaacggttagggtaccgggtccgttaccggacccgtaacccgtaacgtttcccggttacgtttcccgtttcccgtaacgtttcccccgg

SEQ ID NO: 176265 - DNA, 524 bp, Homo sapiens
  misc_feature: GYAE6OF01C296M.17.43.D10.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacngccaccctctcctgcaggggccagtcagagtgtgagcagcaacttagcctggtatcagcagaaacctggccaggctcccaggctcctcatctatggtncttccaccgagggccnctggtctccagccagattcgagggcagtgggctgggacngagttcactcncacatcagcagctgcagtctagaagtatttgctagtttattacgtgtcagtctactaataactaacggtcgggaccccggggggtacttccggacgtaacgggcgtaagggtggagagtacgaaacgacgtgtaggctacgcacgtatctgtctcgtctcccg

SEQ ID NO: 176266 - DNA, 583 bp, Homo sapiens
  misc_feature: GYAE6OF01DOAJB.17.43.D10.1.454.CMB.1.raw
  modified_base (195)..(195): a, c, t, g, unknown or other
  misc_feature (195)..(195): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacngccaccctctcctgcagggccagtcagagtgtgagcagcaacttagcctggtatcagcagaaacctggccaggctcccaggctcctcatctatggtgccttccaccagggccgcgtggtcgtcccagccagattcgagggcaggtgggtctggggacagagttcactctcaccatcagcacgcctgcagtctgaagtatttgctagtttattactgtcagctacttaataaataaccgtcggggacccccggggggtacgttaccgggacccgaaggggaccgaagggtcggaaggtacgtacgaaaaccggtaaacgttggtacgggtccgttacggaccctaaccgtaacgttaccgttcggtttaccttccgtaactttcccccg

SEQ ID NO: 176267 - DNA, 513 bp, Homo sapiens
  misc_feature: GYAE6OF01C6NT2.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctccaggctcctcatctatggtgcttccaccagggccgctggtgtcccagccagattcaggggcaggtgggtctggggacagagttcactctcaccatcagcagcctgcagtctgaatatttgctagtttattactgtcagctatataataacgtcgggaccccggggggattcggaccgaacgggaccaaagggtcggaagatacgaaacgaactggtggctgcacatctgtcttcattcccg

SEQ ID NO: 176268 - DNA, 506 bp, Homo sapiens
  misc_feature: GYAE6OF01B7ONV.17.43.D10.1.454.CMB.1.raw
  modified_base (307)..(307): a, c, t, g, unknown or other
  misc_feature (307)..(307): n is a, c, g, or t
  modified_base (483)..(483): a, c, t, g, unknown or other
  misc_feature (483)..(483): n is a, c, g, or t
  modified_base (501)..(502): a, c, t, g, unknown or other
  misc_feature (501)..(502): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccacaggggccnctggtgtccccagccagattcgaggggcagtggggtctggggacaggagttcactctcaccatcagcagcctgcagtctgaagtattttgctagtttattactgtcagcaatataataacgtcgggccccggggggtattcggacaagggaccaaggtggagatacaaacgactgnggctgcacatctagtctnnttcc

SEQ ID NO: 176269 - DNA, 543 bp, Homo sapiens
  misc_feature: GYAE6OF01EDKEN.17.43.D10.1.454.CMB.1.raw
  modified_base (537)..(537): a, c, t, g, unknown or other
  misc_feature (537)..(537): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtccccagcccagattcgaggggcaggtgggtctgggacaggagttcactctcaccatcagcagcctgcagtctgaagtattttgctagtttattactgtctagcactataataaccgtcgggacccccgggggggtacgttccgggaccgaaggggaccgaagggtagggagagtaccgaaacggtaacgtggtacggctgcacctatcctagttccttctnttcccg

SEQ ID NO: 176270 - DNA, 580 bp, Homo sapiens
  misc_feature: GYAE6OF01CPYK7.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggcctcccaggctcctcatctatggtgcttcccaccaggggcccgctgggtcgtccccagccagacttcgaggggcaggtgggtctggggacaggagttccactctcacctatcagcacgcctgcagtctgaagtattttgctagtttattactgtcagtactacttaataactaacggtccggggtaccccccggggggtagttaccgggaccgaacggggaccgtaaagggtcgggaagtacgtaccgaaaacggtaaccgtggtacgggtctggacccaccgtacttcgttgttccttcgactttccccg

SEQ ID NO: 176271 - DNA, 553 bp, Homo sapiens
  misc_feature: GYAE6OF01BI1MJ.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttagcctggtatcagcagaaacctggccaggctcccaggctcctcatctagtggtgccttcccaccagggccgctgggtctcccagcccagacttcgagggcaggtgggtctgggacagagttcactctcaccatcagcagcctgcagtctgaagtatttgctagttttattactgtcagctactataataacgtcggggaccccggggggtacgttccggaccgaacggggaccgaagggtcggaagtacgtacgaaaacggtacgtggtaggtctacgccaaccacgttccttagttccttcgtcttccccg

SEQ ID NO: 176272 - DNA, 780 bp, Homo sapiens
  misc_feature: GYAE6OF01A1IIW.17.43.D10.1.454.CMB.1.raw
  modified_base (196)..(196): a, c, t, g, unknown or other
  misc_feature (196)..(196): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacngccaccctctcctgcagggccagtcagagtgtgagcagcaacttagcctggtatcagcaagaacctggccaggcctcccgaggcctcctcatcctagtggtcgcctttcccaccgagggccctcgttgggtcgtccccgagcccgtaaggtacgtttccggaagggggtcctaagggttcggggtaccgtagggggtaacctaaggtaacggtttcccgaaccttccgttaccaaacccgtagttcccgaacggcctaacgggtccccttacgggaccgtaacggtttcgtaacggtaaacgggttattttttcggacgtttaacggtttttaacttaccggttcgttaccgaacggtacctaactttaacgtaaacgttaaacccgggttccgggggtacccccccggggggggttaagtttacccgggaacccggaaaccgggggtaaccgtaaacggggtacggggtaacgtaaccggttaaccggtaaaaccgggtaaccgttggggttaacggtcccggttaaggacccgtaacccgtaacgttccgttacggtttcccttacgtaccgtttaccccgg

SEQ ID NO: 176273 - DNA, 548 bp, Homo sapiens
  misc_feature: GYAE6OF01AV04B.17.43.D10.1.454.CMB.1.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccaccagggccnctgggtgtccccagccagacttcgaggggcaggtgggtctgggacagagttcactctcaccntcagcagcctgcagtctagaagtattttgctagtttattactgtcagctactaataataacgtcgggacccccggggggtagttccgggaccgtaacgggaccgaagggtggagacgtacgaaacgtacgtggtacggctcggccaaccgtacgttcgtagttcttcgtacttccccg

SEQ ID NO: 176274 - DNA, 630 bp, Homo sapiens
  misc_feature: GYAE6OF01ALL1W.17.43.D10.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
tcagcgtagactagcacgaccggtgctcgatttagactagcagtaagggggagggaacgtgctcagttaggaccagacggaaccatggaagcccagcgcagcttctcttcctcctgctactctggctcccagatactactggagaaatggtgatgacgcagtctccagccaccctgtctgtttctccaggggaacgngccaccctctcctgcagggccagtcagagtgtnagcagcaactttagcctggtatcagcagaaacctggccaggctcccgaggctcctcactctatggtgccttcccacccgagggcccgcgtgggtcggttccccaggcctacggactttcgaagggggcaaggttggggttccgtacgggggactaacggtaggtttcccacttccgtacacccaagttcccaaggccaagcccttggactaggtctgaaacgtatttttggcttaggttttattaccgttgtacgaagcctaacgttataataaccgttccggggcccccggggggtagttccgaaccgaaaggggtacccaagggtgggacacttacgaaaacgtaccgtaggttcgggcttagacccgtactatcggttactctttccgatttccccg

SEQ ID NO: 176275 - DNA, 542 bp, Homo sapiens
  misc_feature: GYAE6OF01DK1IN.17.43.D10.1.454.CMB.1.raw
  modified_base (331)..(331): a, c, t, g, unknown or other
  misc_feature (331)..(331): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaacctggccaggctcccaggctcctcatctatggtgcttccaccaggggccgctgggtcgtcccagcccagnttcgaggggcaggtgggtctgggacagagttcactctcaccatcagcagcctgcagtctagaagtattttgctagttttattactgtcagctactataataccgtcgggaccccggggggtagttccgggaccgaagggaccgaagggtacggagagtacgaaacgaacgtggtacggcgtgaccacctatctgttccttcgtacttcccg

SEQ ID NO: 176276 - DNA, 562 bp, Homo sapiens
  misc_feature: GYAE6OF01C9TK9.17.43.D10.1.454.CMB.1.raw
  modified_base (196)..(196): a, c, t, g, unknown or other
  misc_feature (196)..(196): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacgngccaccctctcctgcagggccagtcagagtgtgagcagcaacttagcctggtatcagcagaaacctggccaggctcccaggctcctcatctatggtgcttccaccagggccgctggtcgtcccagccagattcgaggggcaggtgggtctggggacagagttcacgtctcaccatcagcagcctgcagtctgaagtattttgctagtttacttactgttcagtctaacttaataaattaaccgtcggggtacccccgggggggtacgtttccgggaccgtaacggggaccgaagggtcggaaggactaccgaaacggaacgtggtaggtccttgaccaccgtacttctagttccttcgtcttcccg

SEQ ID NO: 176277 - DNA, 816 bp, Homo sapiens
  misc_feature: GYAE6OF01D9QP2.17.43.D10.1.454.CMB.1.raw
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
  modified_base (281)..(281): a, c, t, g, unknown or other
  misc_feature (281)..(281): n is a, c, g, or t
tcagcgtagactagcacgaccggtgctcgatttagactagcagtaagggggagaactgctcagttaggacccagacggaaccatggaagccccagcgcagcttctcttcctcctgctactctggctcccagatactactggagaatggtgatgacgcagtctccagccacctgtctgtttcncgaggggaacngccacctctcctgcagggccagtcagagtgtgagcagcaacttgcctggtatcagcagaacctggccaggctcccgagtcctccgtanacttctagtcggtcgccttacccgaccgtacggggtccctgttacgggtcgtccccgaaggccccgtaaggtacgtttccggacggggtcctaacgggttcggggtacctcgggggaactacgggtacgttttccgaaccgttcctacgacccgtagttccgaacggtccgtacgtcccgttacggaccgttacggttaccgttacggtaaacggtttacgttttacggtacgtttaacgggtttttaaccgtttaccggttacggttacccgtaacggtttaacccgttaaccgttaaacggtttaaaccggttaacccgggtttaccccgggggtaccccccggggggggtttaaccgtttaccccggggaacccgggtaaccggggtaacccggttaaacggggtacggggtaacgtaaaccggttaacccgtaaaaccgggtaccgttacgggtaccggtaccggttaccgtaaccgtacccggttaacttaccggttaccgtttacccgttcgttacccggtttaccccg

SEQ ID NO: 176278 - DNA, 543 bp, Homo sapiens
  misc_feature: GYAE6OF01CAO14.17.43.D10.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtncttccaccagggccncgtggtgtccccagccagattcgagggcaggtgggtctgggacagagttcactctcaccatcagcagcctgcagtctgaagtattttgctagtttattactgtcagcatataataacgtcgggaccccggggggtacgttccgggaccgaacggggaccgaagggtcggagtacgtacgaaacgtaacgtaggtacggcgtacgacgaacctactctagttcttgtacttcccg

SEQ ID NO: 176279 - DNA, 575 bp, Homo sapiens
  misc_feature: GYAE6OF01DOGD8.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagcccaccctctcctgcagggccagtcagagtgtgagcagcaacttagcctggtatcagcagaaacctggccaggctcccaggctcctcatctatggtgccttccaccagggccgctggtcgtcccagccagattcgaggggcaggtgggtctgggacagagttcactctcacatcagcagcctgcagtctgaagtatttgactagtttattactgtcagtcaattaataaactaacgtccggggtacccccgggggggtacgttaccgggaccgaacggggaccgtaaaggggtcggaagacgtaccgaaaacggtaacgtaggtaggccgtacgacctaaccgtactaccgttagttccttcgtacgtttaccccg

SEQ ID NO: 176280 - DNA, 615 bp, Homo sapiens
  misc_feature: GYAE6OF01AM8RA.17.43.D10.1.454.CMB.1.raw
  modified_base (436)..(436): a, c, t, g, unknown or other
  misc_feature (436)..(436): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttgcctggtatcagcagaaacctggccaggctcccgaggctcctcatctagtggtcgtccttccgaccgtacggggcccgtcgttcgggtcgtccccgagccccgaaggtactttccggagggggcctagggtcggggtcgtggggacaggtacgttcacctctaccaccatcgagcacgcctgcagtctagtaagtnttttcgctagtttacttactgtacagtcaacttaataacgtaaccggtcgggggtaccccggggggtagttcccgggaccgtaacggggaccgaagggtcggaacgtacgtacgaaaacggtacgtggtacggtctacggacccaaccgtacgttacttcggttcttcgtcgttccccg

SEQ ID NO: 176281 - DNA, 619 bp, Homo sapiens
  misc_feature: GYAE6OF01DX9PV.17.43.D10.1.454.CMB.1.raw
  modified_base (285)..(285): a, c, t, g, unknown or other
  misc_feature (285)..(285): n is a, c, g, or t
  modified_base (404)..(404): a, c, t, g, unknown or other
  misc_feature (404)..(404): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtcttgtttctccgaggggaacgagcccaccctctcctgcagggccagtcagagtgtgagcagcaacttagcctggtatcagcagaacctggccaggctccaggctcctnatctagtggtcgccttccaccgtagggcctcgtgggtcgtcccagccagattcgagggcaggtgggtctgggacaggagttcacttctcaccatcagcagcctgctagtctagaacgtnttttagcttagttttactacgtgtacagtactaacttaataacgtaaccggtccgggggacccccggggggttattaccggggacccgtaaacgggggacccgtaaaggggtcgggtaaggtaacgtaaccggaaaaccggtaacgtagggtacgggtctacgggaccctaaccgtaacttcgttacgtttacccttaccgtacgtttacccccg

SEQ ID NO: 176282 - DNA, 546 bp, Homo sapiens
  misc_feature: GYAE6OF01BBH3I.17.43.D10.1.454.CMB.1.raw
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (392)..(392): a, c, t, g, unknown or other
  misc_feature (392)..(392): n is a, c, g, or t
  modified_base (536)..(536): a, c, t, g, unknown or other
  misc_feature (536)..(536): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggcctcccaggctcctcatctatggtncttccaccgagggccnctggtcgtcccagccagacttcgagggcaggtgggtctgggacagagttcactctcaccatcagcagcctgcagtctgaagtntttgctagtttatactgtcagtcacttaataactaaccgtcggggccccggggggtagttccgggaccgtaagggaccgaaggtggaagtagtacgaaacggtacttggtcggctacggactaccgtacttcgtagttcccttntcttaccccg

SEQ ID NO: 176283 - DNA, 543 bp, Homo sapiens
  misc_feature: GYAE6OF01CN39Y.17.43.D10.1.454.CMB.1.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccacctctcctgcagggccagtcagagtgtgagcagcaacttagcctggtatcagcagaaacctggccaggctccaggctcctcatctatggtncttccaccagggccgctgggtgtccccagccagattcgaggggcaggtgggtctggggacaggagttcactctcaccntcagcagcctgcagtctgaagtattttgctagtttattactgtcagctaactataactaacgtcggggacccccggggggtagttccgggaccgaaggggaccaagggtgggaagtacgtacgaaacggtacgttggacggtctcggacacctactctgtccttcacgttccccg

SEQ ID NO: 176284 - DNA, 520 bp, Homo sapiens
  misc_feature: GYAE6OF01BKWGH.17.43.D10.1.454.CMB.1.raw
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctcatctatggtgcttccaccagggccgctggtgtcccagccagattcagggcagtgggtctgggacagagttcactctcaccatcagcagcctgcagtctgaagattttgctagtttattactgtcagcactataataacgtcgggcccccggggggtacgttccgggaccgtaacgggaccgaagggtggagtatacgaaacgaacgtgtaggctagcaccatctgtcttcattcccg

SEQ ID NO: 176285 - DNA, 600 bp, Homo sapiens
  misc_feature: GYAE6OF01EEB9D.17.43.D10.1.454.CMB.1.raw
  modified_base (416)..(416): a, c, t, g, unknown or other
  misc_feature (416)..(416): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcagaaacctggccaggctcccaggcctcctcatctatggtgccttccaccgacgggcccgcgtggtcgtccccagccagacttcgaggggcagggtcgggtcgtggggacaggtacgttcaccgtctccgacctatcagcacgcctgcagtctagaagtntttgcttagtttattactgtcagtactacttataaacgtaacggtccgggggacccccggggggtagttaccgggaccgtaacggggacccgaagggtcggaacggtacgtaaccgaaacggtacgttggtacgggtcctacggaccaaccgtacttccgtagttccttccgtcgttacccccg

SEQ ID NO: 176286 - DNA, 756 bp, Homo sapiens
  misc_feature: GYAE6OF01DUD6C.17.43.D10.1.454.CMB.1.raw
  modified_base (185)..(185): a, c, t, g, unknown or other
  misc_feature (185)..(185): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagccaccctctcctgcagggccagtcagagtgtgagcagcaacttgcctggtatcagcagaacctggccaggcctcccgaggcctcctcatctagtggtcgccttcccgaccgaggggcccgcgttcgggtcgtccccgaggcccctaaggtacttccggaacgggggcctaagggttcgggggtcgtagggggaactaggtacggttccaccttccgtaccaccctaatccgaacggccacgccgttggacctagttaccgttaaggtaacgttagttttacggactttaaggttttaactttacgttgtacctaagtaacctaacgttaacgttaaacgttaaaccgggttcccggggggtaacccccggggggggttaccggtttacccggggaacccggtaaaccgggggtaacccggtaaaaggggtacgggtaacggtaaccgtaaaccggaaaaccgggtaaccggttacgggtacgggtcccgttaccggtacccgtaacccgttaacgttacccgtttacgtttccctttaccgtaacccgtttcccccgg

SEQ ID NO: 176287 - DNA, 758 bp, Homo sapiens
  misc_feature: GYAE6OF01DAV3E.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttctccgaggggaacacgcccaccctctcctgcgagggccaagtcagacgtgtgacgcagtcaacgttagccgtaggtatccaggacaggaaacctgggaccagggcctcccgaggtcctccgtctaactctagtcgggttacaccgtttccgaccgtaggggccctcgttcgggtccgtacccaggccctaaggtactttcggacggggtcctacgggggttcggggttaccgtacgggggtaacacgggttacgtttcccacgttcccgttaacgaccctaagttcccgaacgggtcctacggtccctagggacctaacgggtttcctaggtaaactttcgttttacggaacgttaggtttttactacgttgttacctacggtactaacgttaattaccggaaccgggttcccgggggtaccccgggggttattacccgggaaccggtaaacgggaccggtaaggggttaggacgtaaccgtaaccgtaaaaaccgggtcgttacgggtacggccttacggacccgtttaacgtacgtacggtttaccgttaccgtttaaccgcggttttacccccg

SEQ ID NO: 176288 - DNA, 907 bp, Homo sapiens
  misc_feature: GYAE6OF01DMW8K.17.43.D10.1.454.CMB.1.raw
  modified_base (199)..(199): a, c, t, g, unknown or other
  misc_feature (199)..(199): n is a, c, g, or t
tcagcgtagactagcacgaccggtgctcgatttagactagcagtaagggggagggtaacgtgcgtcagttaggacccagacggaaccagtggaacgcccagcgcacgcttctcttcctcctgcttactctggctcccagatactactggagtaaagtggtgatgacgtctagtctccagtacctacctgtcttgtttcnccggaggggacacgccctacccgtcgtccgtcggcgacgggtccaggtccgagggtacgttggtacgacgacgacggactaacgttacggccgttggttactacgagaccaacgaaaccgtcggaccgacggcctcccgacgtcctaccgtcgtacgtcgtacgtcggtcgtacccgttacccggaaccggtacgggtccgtcggttcgggttaccgtccccgaacgtaccgtaacggtaacgttaccgggaacggggtaccgtaacgggggtttcggggtacggttaacggggtaacgttaacgggttaccggtttaccgtaaccgttcccgttaaccgaacccgtaacgttaccggaacgggtacccgtaaccggtacccgttacggaccgttaacggttacgttaagggttaaacgtttacgtttttacggaacgttttaaggttttaaccgttacggttacgtaaccgtaacgttaacttaaacgttaaacgttaaaccgggtaacccggggtaccccgggggggtaacccccggggggttaacgttaaccccggggaaacggtaaaccgggggtaaccggtaaacggggttacggtaacgtaaaccggttaaaccggaaaccggttacggtacgggtacggtccgtaccggtaacccttacggttactttccgttaccgtttcctttaccgccgtttaccccg

SEQ ID NO: 176289 - DNA, 550 bp, Homo sapiens
  misc_feature: GYAE6OF01BI7KZ.17.43.D10.1.454.CMB.1.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggcctcctcatctatggtncttcccaccgaggggcccncgtgggtcgtccccagcccagacttcgaggggccaggtcggggtctggggacaggagttcacgtctcaccatcagcacgcctgctagtctgaacgtattttcgcttagttttattactgtcagctaactataactaacgtcggggaccccgggggtacttcgggaccgaagggaccgaagggtggagacgtacgaaacggtacgtgaggctgaccacctatctgtcttcgtcttcccg

SEQ ID NO: 176290 - DNA, 534 bp, Homo sapiens
  misc_feature: GYAE6OF01B631W.17.43.D10.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcatgcagggccagtcagagtgtgagcagcaacttagcctggtatcagcagaacctggccaggctcccaggctcctcatctatggtncttccaccngggccncgtggtgtccccagccagacttcgaggggcaggtgggtctggggacaggagtttcactcgtcaccatcagcagcctgcagtctgaagtattttgactagtttattactgtcagctactaataacgtaacgtcggggtacccccggggggtacgttccgggaccgaacgggaccgaagggtggagacgtacgaaacgtacgtggtgcgtgacacatctcgtctctac

SEQ ID NO: 176291 - DNA, 606 bp, Homo sapiens
  misc_feature: GYAE6OF01CG1OI.17.43.D10.1.454.CMB.1.raw
  modified_base (186)..(186): a, c, t, g, unknown or other
  misc_feature (186)..(186): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (411)..(411): a, c, t, g, unknown or other
  misc_feature (411)..(411): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggaagaaatggtgatgacgcagtctccagccacctgtctgtttcnccgaggggacagccacctctcctgccagggccaggtcagagtgtgagcagcaacttagccttaggatcagcagaactggccaggctccaggctcnatctangtnctccacgngggccncgtggcgtcccagtccaagcttacgagggcagggtcggtctaggggacagacgttccatccgtcaacctatccgagccgaacgctcgacgtagtcgtaggaacgttntttacggcttaagtttacgtacgtcgttacacgtactaacgtaacttaacgacggtacccggggtaccccgggggtacttaccgggaccgtaacgggaccgtaaacggtcggtaaagacgtaaacgaaaccggtcgttacgggaggtccgtacgacctacgtacgtaccgtacggttaactcgtcgtttaccccg

SEQ ID NO: 176292 - DNA, 804 bp, Homo sapiens
  misc_feature: GYAE6OF01D6BBX.17.43.D10.1.454.CMB.1.raw
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
tcagcgtagactagcacgaccggtgctcgatttagactagcagtaaggggaggaactgctcagttaggacccagacggaaccatggaagcccagcgcagcttctcttcctcctgctactctggctcccagatactactggagaaatggtgatgacgcagtctccagccacctgtctgtttcnccgaggggaacncgccaccctctacctgcagggccagtcagagtgtgancagcaacttagcctggtatcagctaagaaccgtggccaggcctcccgaggcctcctcactctagtcggtcgtccttaccaccgacgggccgtcgttcggtacgtaccccagcccgtaacggtacgtttccggaacggggcgtaacggggttcgggggtccgtagggggtaccaacgggtacgtttacctaaccgtccttaaccgacccgtaacgttacaagggggccctaaggccccgttacggcccgtaacggttaccgttacgggttaaaaggtaccgttttttaagggtcccttaagggtttttaacttttaacccgttaggtttcccaaagggttcttaaccgtaaactttaaaggtaaaccccgggttacgggtacccccccggggggggggtaaccgtttttaccggggggacccctaaaagggggttaaccccggaaagggttacggggaacggtaaaccggttaagaaaaacccgggtaaaccggttagggttaccgggtccggttaccgggaaccgtaacccgtaacgttaccgtttacgttcctttcgtaaaccgttccccgg

SEQ ID NO: 176293 - DNA, 520 bp, Homo sapiens
  misc_feature: GYAE6OF01CKOXF.17.43.D10.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccgaggggaacngccaccctctcctgcagggccagtcagagtgtgagcagcaacttagcctggtatcagcagaaacctggccaggctcccaggctcctcatctatggtgcttccaccagggccgctggtcgtcccagccagatcgagggcaggtgggtctgggacngagttcactcncaccatcagcagcctgcagtctgaagtattttgctagtttattactgtcagctactataatacgtcgggaccccggggggtacttcggaccgaagggaccgaagggtggagagtacgaaacgacgtggaggctgacactactcgtgtcttcgcttcccg

SEQ ID NO: 176294 - DNA, 572 bp, Homo sapiens
  misc_feature: GYAE6OF01BVWAH.17.43.D10.1.454.CMB.1.raw
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (391)..(391): a, c, t, g, unknown or other
  misc_feature (391)..(391): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctcatctagtggtgccttcccaccagggccgctggtcgtcccagccagnttcgagggcaggtgggtctgggacagngttcactctcaccatcagcagcctgcagtctagaatntttgctagtttatactgtctagctattaataataacggtccggggacccccggggggtaagttccgggaccgtaaggggacccgtaaagggtcgggaagtacgtaaccgtaaacggtaacgttagggtacggaccgttagccgtaacccgtagttcgtacgttcttaccgtagttaccccg

SEQ ID NO: 176295 - DNA, 595 bp, Homo sapiens
  misc_feature: GYAE6OF01EGQZ1.17.43.D10.1.454.CMB.1.raw
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcncaggggacngccacctctcctgcagggccagtcagagtgtgagcagcaacttagcctggtatcagcagaaacctggccaggctcccaggcctcctcatctagtggtgccttccaccgagggccgtcgtggtcgtcccagccagtacttcgagggcaggtgggtctgggactaggagttcactctcaccatcagcacgtcctgctagtctagaagtattttcgacttagttttatacgtgtactagacctaataacttaacgtaaccggtccggggtacccccgggggggtaagtttcccgggaacccggtaacggggaccgtaacgggttgggaacgtacgtaacgaaaccggtaacgtgggtacggcgtacgaccaaccgtattacgttacgttcttccgcttaccccg

SEQ ID NO: 176296 - DNA, 616 bp, Homo sapiens
  misc_feature: GYAE6OF01AS0TG.17.43.D10.1.454.CMB.1.raw
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacngccaccctctcctgcagggccagtcagagtgtgagcagcaacttagcctggtatcagcagaacctggccaggcctccaggctcctcatctagtcggtcgccttccgaccgacggggcccgtcgtcgggtcgtccccgagccctagtacgttcggaacggggtcagggtggggtcgtggggacaggtacgttcgacctctaccacctatccgagcacgcctgctacgtcgtagtaacgttagttttagacttaagttttacttacttcgtactagtactaacttaagtaacgttaaccggtccggggtaccccggggggtacgttccgggaaccgtaacggggaccgagggtacggaggacgtaacgaaacgtacgtggacggtctacgacctacgtcttacgtagtcttcgtcgttcccg

SEQ ID NO: 176297 - DNA, 578 bp, Homo sapiens
  misc_feature: GYAE6OF01BU58F.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccacccctctcctgcagggccagtcagagtgtgagcagcaacttagcctggtatcagcagaaacctggccaggctcccaggcctcctcatctatggtgccttccaccgagggccgcgtggtcgtcccagccagacttcgagggcaggtgggtcgtggggacaggtagtttcactctcgaacccatcagtcagcctgcagtctagaatattttgacttagtttatactgtacagtctaacttaataacgtaaccggtccggggacccccggggggtacgttccgggaccgaagggaccaagggtggagtaataccgaaaacgtacggtggtacggcgtacgaccaaccgtacttacctagttccttctacgttaccccg

SEQ ID NO: 176298 - DNA, 540 bp, Homo sapiens
  misc_feature: GYAE6OF01B26WX.17.43.D10.1.454.CMB.1.raw
  modified_base (204)..(204): a, c, t, g, unknown or other
  misc_feature (204)..(204): n is a, c, g, or t
  modified_base (518)..(518): a, c, t, g, unknown or other
  misc_feature (518)..(518): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctntcctgcagggccagtcagagtgtgagcagcaacttagcctggtatcagcagaaacctggccaggctcccaggctcctcatctatggtgccttccaccgaggggccgctggtcgtccccagccagattcgaggggcaggtggggtctgggacagagttcactctcaccatcagcagcctgcagtctagaagtatttgacttagtttattactgtcatcaatataagtaccgtcgggaccccggggggtattccggaccgaagggaccgaagggtggagagtaccgaaacgtaacgtggacggtctcgacaccgtntacgtgttccttctcttccccg

SEQ ID NO: 176299 - DNA, 556 bp, Homo sapiens
  misc_feature: GYAE6OF01BXLEU.17.43.D10.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (526)..(526): a, c, t, g, unknown or other
  misc_feature (526)..(526): n is a, c, g, or t
  modified_base (549)..(549): a, c, t, g, unknown or other
  misc_feature (549)..(549): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcagaaacctggccaggctcccaggctcctcatctatggtncttccgaccagggccnctggtcgtcccagccagattcgagggcaggtgggtctggggacaggtacgttcacgtctacaccatcagcagcctgcagtctagtaagtattttgcttagtttatacttgtacagtactaacttaataacgtaaccggtcggggtacccccggggggtagttccgggaccgaagggtaccgaagggtcggagatacgaaacgacgtggacggntacgcacgtactcttagtccttncttcccg

SEQ ID NO: 176300 - DNA, 655 bp, Homo sapiens
  misc_feature: GYAE6OF01CFIWB.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcaagaaacctggccaggcctcccgaggcctcctctatctagtcggtcgccttccgaccgagggcccgcgtcgggtcgtccccagccctaaggtacttccggacggggtctagggtcggggtcgtaggggacaggtcgttcactctacaccatcagcacgcctgccagtctagtagtatttcgacttagttttactacttgtactacgtactaacttaataaacgttaacccggtccgggggtacccccgggggggtacgtttacccgggaaccggaacggggtaccgtaaacggggtacgggaacggtaacgtaacccggaaaacggtaccggttacgggtacgggtccgtacggaccgtaaccgtacttccgttacgtttaccttccgtactttccccg

SEQ ID NO: 176301 - DNA, 652 bp, Homo sapiens
  misc_feature: GYAE6OF01A06H7.17.43.D10.1.454.CMB.1.raw
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtatcagcaagaacctggaccaggctcccgaggcctcctcacttctagtggtcgtccttcccaccggacgggcccgtcgtcggtcgtccccagccagtacgttcggaggggccagggtcggggtctggggaacaggtagttcacttctaccaaccgatcgagcgacgtcctgctacgtcgtaggtaagttattttgacttagttttaacttacgttacgtctaacgtactaacgttaagttaacgttaacccggtccgggggtacccccgggggggttaacgttcccggggtaacccgtaacggggaaccgtaaggggtacggtaaggaacgttaaccggaaaaccggtacggtaggtacggcgtcgaccgtaccgtacttccgttgttaccttcgtaccgttcccg

SEQ ID NO: 176302 - DNA, 613 bp, Homo sapiens
  misc_feature: GYAE6OF01D8JQW.17.43.D10.1.454.CMB.1.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (414)..(414): a, c, t, g, unknown or other
  misc_feature (414)..(414): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcagaacctggccaggcctccaggctcctcatctatggtnccttccaccgagggcccngtcggtcgtccccagccagtattcgaggggtcagggtgggtctaggggacaggtacgttcactctaccaccatccgagcagcctgctagtctagaagttntttgacttagttttactacgttgtcagtacaacttaataagtaaccggtccggggtacccccgggggggtacttaccggggaaccgtaacggggaccgtaagggtaggaacgtaacgtaccgaaaacggtacgtagggtacgggccttacggaccctaaccgtacttccgttacggttcctttaccgaccgtttccccg

SEQ ID NO: 176303 - DNA, 831 bp, Homo sapiens
  misc_feature: GYAE6OF01CV5OQ.17.43.D10.1.454.CMB.1.raw
  modified_base (187)..(187): a, c, t, g, unknown or other
  misc_feature (187)..(187): n is a, c, g, or t
  modified_base (255)..(255): a, c, t, g, unknown or other
  misc_feature (255)..(255): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagcccaccctctcctgcagggccagtcagagtgtgagcagctaacttagcctggtancagacaagaactggaccaggcctccgagcctctcatcgtatggtcgccttacccgaccgacgggcctcgttggtccgacccagccgaagtacgttcggacggggtacacgggtttcggggtaccgtagggggaacctagggtacttcccgtaacgttccgttaccgaacctaacgtccgaacggacctaaccggtcccgttacggacgtaacggttaccgttaggttaaaggtttacgtttttacggtaaccgtttaaggtttttaaccgtttacgttacgttaccgtaaacggtaccttaaaccgttaaagtttaaaccggttaaacccggggttccccggggggttaaccccccggggggggttaccgtttacccgggggaaacccgggtaaaaccggggggtaaccccggtaaaagggggttaaccgggtaaaccggtaaaccggttaaacccgggtaaaaccgggtaaaccggtttaggggtaacccgggtacccgttaccggaaacccgttaaacccgttacgtttaccggttaccggtttaccctttaccgttaacccggtttacccccg

SEQ ID NO: 176304 - DNA, 588 bp, Homo sapiens
  misc_feature: GYAE6OF01D8669.17.43.D10.1.454.CMB.1.raw
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcagaacctggccaggctcccaggctcctcatctatggtcgcttccaccgagggcccgcgttgggtcgtccccagccagattcgaggggcaggtgggtctgggacagtacgttcactctcaccatcagcagcctgcagtctagaagtattttgcttagtttattactgtcagcactataactacgtcgggacccccggggggtagttccgggaccgaaggggaccgtaaggggtcggaagtacgtaacgaaaaccggtaacgttgggtacgggtccttacgggaccctaaacccgtacgttaccgttggtttccctttacgtaccgtttaccccg

SEQ ID NO: 176305 - DNA, 557 bp, Homo sapiens
  misc_feature: GYAE6OF01AZG0Z.17.43.D10.1.454.CMB.1.raw
  modified_base (295)..(295): a, c, t, g, unknown or other
  misc_feature (295)..(295): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtncttccacctagggccgctggtcgtcccagccagattcgagggcaggtgggtctgggacaggagttcgactctcaccatcagcagcctgcagtctgaagtattttgctagtttatactgtcagcactaatactaacgtcgggaccccgggggtacgttccgggaccgtaacgggacccgaagggtcggaagtacgtaacgaaaccggtaacgttgggtcggctcggacctacccgtattccttagtccttcgtcgtttccccg

SEQ ID NO: 176306 - DNA, 626 bp, Homo sapiens
  misc_feature: GYAE6OF01EOPC6.17.43.D10.1.454.CMB.1.raw
  modified_base (295)..(295): a, c, t, g, unknown or other
  misc_feature (295)..(295): n is a, c, g, or t
  modified_base (407)..(407): a, c, t, g, unknown or other
  misc_feature (407)..(407): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggcctcccaggctcctcatctagtcggtnccttccaccgagggcccgcgtggtcgtcccgagccagacttcgagggcaggtcgggtctggggacaggtagttcacgtctcacctatcgagcagcctgctagtctagaagtntttgactagttttactactgtacacgtactacttaataaacgttaaccggtacgggggtaccccccgggggggtacgtttcccgggaacccgtaacgggtaccgtaacccggtaaagggttacgggaacggtaacgtaaccggtaaaaccgtaacggttacggtcgggtaccgtacggaccgtaaccctacgttccgttacgttccgtttcgttacccg

SEQ ID NO: 176307 - DNA, 750 bp, Homo sapiens
  misc_feature: GYAE6OF01AF8MI.17.43.D10.1.454.CMB.1.raw
  modified_base (196)..(196): a, c, t, g, unknown or other
  misc_feature (196)..(196): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccaggggaacgngccaccctctcctgcagggccagtcagagtgtgagcagcaacttagcctggtatcagcaagaaacctggccaggcctacccgaggcctcctcattcctagtggtctccttcccaccgacgggccgtcgtacgggtcgtcccagcccaaggtcttcggacggggtctaagggtcggggtcgtaggggaactaggtaggtttccaccgttcctaccgaccctaagtccgaagcgtaacgtcccttacggacctaggttacccgttaaggtaaacgttagttttttacggacctttaaggtttttaacttaccgtttacggttacctaacgtacctaacgttaaagttaaacggttaaacccggggttcccggggggtaacccccccgggggggggttaacgtttacccgggggaacccggtaaaaccgggggtaacccggtaaacgggggttacgggaaacggtaaaccgtaaaccgaaaaccgggtaacgttagggtacggtccgtaccgactaacccgtaagttaccgtacgtttaccttcgtccgttaccccg

SEQ ID NO: 176308 - DNA, 588 bp, Homo sapiens
  misc_feature: GYAE6OF01CTK2I.17.43.D10.1.454.CMB.1.raw
  modified_base (185)..(185): a, c, t, g, unknown or other
  misc_feature (185)..(185): n is a, c, g, or t
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctntcctgcagggccagtcagagtgtgagcagctaacttagcctggtatcagcagaaacctggccaggctcccaggctcctcatctatggtnccttccaccgagggccnctcgggtcgtcccagccagattcgaggggcaggtgggtctgggacagagttcactctcaccatcagcagcctgcagtctgaagtatttgctagtttatacgtgtctagctatataacgtaaccggtcgggtaccccggggggtacgttacgggaccgaacggggaccgtaaggggtacggacggaacgttaccgaaaacggtaacgttcgggttacgggccttacggaccgtaacccgtaagttccttacggttacctttacgtaccgtttaccccg

SEQ ID NO: 176309 - DNA, 557 bp, Homo sapiens
  misc_feature: GYAE6OF01DVXYX.17.43.D10.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (417)..(417): a, c, t, g, unknown or other
  misc_feature (417)..(417): n is a, c, g, or t
  modified_base (549)..(549): a, c, t, g, unknown or other
  misc_feature (549)..(549): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctccncatctatggtncttccacgcggccgctggtgtcccagccagacttcgaggggcaggtgggtcgtggggacaggtcgttcactctcaccatcagcagcctgctagtctgaagtatttgacttagtttattacgtntcagctaacttaataaacgttacggtccggggtaccccggggggtacgttaccgggaccgaacggggtaccaagggtaggagacgtacgaaacggacgtggtaggcctagccacctactcgttagttccttntcttcccg

SEQ ID NO: 176310 - DNA, 554 bp, Homo sapiens
  misc_feature: GYAE6OF01COQWM.17.43.D10.1.454.CMB.1.raw
  modified_base (308)..(308): a, c, t, g, unknown or other
  misc_feature (308)..(308): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctctcctgcagggccagtcagagtgtgagcagcaacttagcctggtatcagcagaacctggccaggctcccaggctcctcatctatggtgccttccaccgagggccnctggtcgtccccagccagattcgaggggcaggtgggtctggggacaggagttcactctcaccatcagcagcctgcagtctagaagtatttgctagttttattactgtcagcaacttataacgtaacgtcgggaccccggggggtagttccgggaccgtaacggggaccgaagggtggaagtacgtacgaaaacgtacgttggtacggtcgtacgacgaaccgtactctcgttcttcgtacttcccg

SEQ ID NO: 176311 - DNA, 695 bp, Homo sapiens
  misc_feature: GYAE6OF01B2AUP.17.43.D10.1.454.CMB.1.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
  modified_base (461)..(461): a, c, t, g, unknown or other
  misc_feature (461)..(461): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttctccgaggggaacngccacctctcctgcaggccaggtcagagtgtgacgcagcaacttgccttggtatcgagacaacgaaactggaccaggcctcccgaggtctccctnactctagtcggtcgtccttcccgaccgagggtcctcgtggtccgtaccagccgtaaggtacttcggaaggggtcctaggggttgggtaccgtgggaaccgaggttacgttccaacttccgtacaccgaagttcgaacgccgacgtcctcggctaggttctaggtaaagttnttttcgaactttagttttaatacgtgtaccagactaacgttaacgttaacgtaaccgggtcccgggggaccccgggggttaacgtaccgggaccgaaacgggtacccgaaaggggtacggaaggtaaccttaacgggaaaacccgttaaaggttccgggacggtacccgttcggaaacccgtaccccgttaagttcccggttaacggttccctttaagccccgttttaaccccg

SEQ ID NO: 176312 - DNA, 755 bp, Homo sapiens
  misc_feature: GYAE6OF01BRM20.17.43.D10.1.454.CMB.1.raw
  modified_base (193)..(193): a, c, t, g, unknown or other
  misc_feature (193)..(193): n is a, c, g, or t
tcagcgtagactagcacgaccggtgctcgatttagactagcagtaagggaggaacctagctccagttagggacccaagaccggaaccatggaagccccagccgcagcttcgtcttccgtcctgctactctggtctccagatactactggagaaatggtcgatcgacgcagtctccagccacctgtctgtttcnccgaggggaacgacgcccaccctcgtccctggcgagggccagtcagagtgtgagcagactaacttagcctggtatcgagtacgaacgaaacccgtggacccgacggcctacccgaggtccttaccgtacgtacgttcgtaggtcggttcgtaccttacccgacggacgggtccctcgtacggttcgtaccccagacccaagtcgtcggacgggctagggtcgggtcgtagggacaggtacgttccacgtcctacaacctagtccgaacgccacgtccccgtgaccgtacgttccgtaagtaacgttagttttaccggacgtttaagttttactaccgttacgtactaggtaccttaagttaacgtaaccggttaacccggggtccccggggggtacccccgggggttaagtttacccgggaacccggaacggggtaacccgtaaggggtcggaaacgtaaccgtaaaccggtaaaacggtacgttacggacggtccgtaccgtacccgtaaccgttacgttaccggttaccggtttacccgttaccgtaccgtttcccccgg

SEQ ID NO: 176313 - DNA, 615 bp, Homo sapiens
  misc_feature: GYAE6OF01BZVXR.17.43.D10.1.454.CMB.1.raw
  modified_base (415)..(415): a, c, t, g, unknown or other
  misc_feature (415)..(415): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacgttagctggtatcagcaagaaacctggaccaggcctcccgaggcctccctcacttctagttcgggtacgtccttacccgacgtacggggcccgtctcgggtctccccgagcctaggtacttcggaggggcctagggtggggtcctggggactaggtacgtctactctacaaccntcgacgctagcctggactgtactagattatttcgacttagtttatctgtcagtactaattaataacggttaacggtccggggggaccccgggggttaagtccggaacccggaagggtacccgaaagggtcgggaactacgtaaccgaaacggtcgtaggtcggcgtcgactactacgttcgttagtccttagcttccccg

SEQ ID NO: 176314 - DNA, 935 bp, Homo sapiens
  misc_feature: GYAE6OF01EVT5P.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcgagggccagtcagagtgtgagcagacctaacgttacgccgtaggtactcgaagaccaacggtaaacccgtcggacccaggccctacccgaggccttcccgtactaacttccgttaaggtcgggttacgtacccctttacccgaacccgggtaacggggtccccgtcggttacgggttcccgttacccccgaacggtaccccgtaagggttaccgtttaccgggaacggggggtccttaacgggggtttcgggggttacccgttacggggggaaccttaaacggggttaccgttttacccgaacccgtttaccgttacccgaaaccctaacgttacccgaacgggtccgaaccggtcccgttacgggaccgttaccgggtttacgttaacgggtaaaacggtttacgtttttttacggaacgttttacggtttttttaaacgtttaaccgtttacggttaccgtaacggttaccttaaacggtttaaacttaaaccggtttaaacccggggttccccggggggtaaccccccgggggggttacggtttacccggggaaacccggtaaacggggtaacccggtaaacgggggtacgggtaaaccggttacgtaaacccgggtaaaacggtaaccggttaggggtaaccggtccggtaaccggtacccgtaaacccgttaccgtttaccgttaccgtttcctttacccgaccgttttacccccgg

SEQ ID NO: 176315 - DNA, 607 bp, Homo sapiens
  misc_feature: GYAE6OF01DOWG0.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccacctctcctgcagggccagtcagagtgtgagcagcaacttagcctggtatcagacagaaacctggaccaggcctcccaggctcctcatctatggtgtccttccacgagggccgcgtgggtcgtcccagccagtactcggaggggcagggtcgggtcgtggggacaggtacgttccacgttcctaccaccgtatcgagcacgccctaggctaggttctagtaagttagttttcgacttagttttacttactgttacagctaacttaataaacgtaccggtaccggggtaccccggggggtagttccgggaccgaacgggaccgaagggtacggacgtacgtaacgaaacggtacgtggtacggtccgtagtaccaccgtacgttctagttcctcgtcttaccccg

SEQ ID NO: 176316 - DNA, 749 bp, Homo sapiens
  misc_feature: GYAE6OF01AWGAD.17.43.D10.1.454.CMB.1.raw
  modified_base (287)..(287): a, c, t, g, unknown or other
  misc_feature (287)..(287): n is a, c, g, or t
  modified_base (405)..(405): a, c, t, g, unknown or other
  misc_feature (405)..(405): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagccaccctctcctgcagggccagtcagagtgtgagcagcaacttagcctaggtatcagcaagaaacctggccaggcctccgaggcctcctnacttctagtggtcgccttccgaccgacgggcccgtcggtcggtcgtcccgagccgagtacgttcggaggggtcagggtgggtcgtaggggacaggtacgttcacgtcctacgaacctntacgacgtcacggtccctaggacctacggtacgttaggtaacgtttagtttttcggtaccgtttaagtttttaacgttacgttcggttaacaacggtacttaaacgtttaacgttaaaccggtaacccggggttcccgggggggtacccccgggggggttaaccggttcccggggaaacccgggtaacgggggtaacccggtaaaggggggttccgaaacggttaaccggttaaacccggaaaacgggtaccggttaggggttaccggtaccgttaaccggaccctaaccgttacgtttacccggttacgtttcccgtttaacccgttcccgtttaccccccgg

SEQ ID NO: 176317 - DNA, 658 bp, Homo sapiens
  misc_feature: GYAE6OF01DN0Y3.17.43.D10.1.454.CMB.1.raw
  modified_base (414)..(414): a, c, t, g, unknown or other
  misc_feature (414)..(414): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggatcagacaacgaaacctggccaggcctcccgaggctcctcatctagtggtcgtccttccgaaccgacggggccgcgttgggtcgtacccagacccagtacttcgaggggcaggtgggtcgtgggacagacgttcactctcacatcagcagcctgctagtctgaagtnttttgctagtttacttacgtgtacagtactacgttaagtaaacgttaaccggtaccgggggtaccccccggggggggttacgtttcccggggaacccgtaaacgggggtaacccgtaaaggggttacggggaaacgtaaccgttaaccggaaaaccgggtaaccgttggggttacggtcccgttacggacccgtaacccgttacttaccggttaccgtttacccgtttccgtacgtttcccccg

SEQ ID NO: 176318 - DNA, 838 bp, Homo sapiens
  misc_feature: GYAE6OF01A3NWP.17.43.D10.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcncgaggggacgngccaccctcctcgcgcggcggctacgtacgagtgtgagacgacgacgtactaagtccgtcggttagtacacgacgacgaaaccgtaccggcgacggcgtcccacggcgtccctctactcttgtagttcggtcctaccgtacccgacgggtcccggtccgtcgggttccggtacccgaccggtcgacgtagttaccggtacgggggacggtacggtgggggttcggtacggacggtaacggtacggttaccttaccgtaccctccgttaacccaacgttaccgacggaccgtacccggtaccgttaccggacgtaaccgttacggtttaacggttaaacggtaacgtttttttcggttaccgttaaagttttttacggttttaaactcggttacgtaacgtactttaacgttaaaaccgtttaaagtaccccggggtttaacccggggggggccccccggggggggttaaaccccgggggtttcgtaacccggggtaaacgggtaacccgggtaacgggtaaggggtaacggtaacgttaaaccgggaaaaccgtaaccggtacggttcggggacgttacgacccggtaaaccttacgttacgtttcgtttaccgttacttaacccgtttcccgttaacccccg

SEQ ID NO: 176319 - DNA, 810 bp, Homo sapiens
  misc_feature: GYAE6OF01C8HX1.17.43.D10.1.454.CMB.1.raw
  modified_base (187)..(187): a, c, t, g, unknown or other
  misc_feature (187)..(187): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttcnccgaggggacagccacctctcctgcagggccagtcagagtgtgagcagcaacttagcctggtatcagcaagaacctggccaggctcccgaggctcctcattctagtggtcgtccttcccgaaccgacggggtcccgacgttcggggttccgtacccccgaggccccgtaaggtacgtttccggaacggggggtccaagggggtttcggggtaccgttaggggggaacctagggtacgtttaccaaccgttcctaccaaccctaagtccgaagccgaacggtccccgttaggacctacggttccgtaaggtaaacggttagttttttacggactttaagggtttttaacctttacgttacggttacccgtaaggtacccttaaacgtttaaacgttaaaaccggtttaaacccgggttccccgggggggtaacccccccgggggggggttaacgtttacccgggggaaccccgtaaacggggggtaaccccgtaaaggggggttacgggtaaacggtaacgttaaaccggaaaaaccgggtaccggttagggtaccgggtaccgtacggacccgttaaccgtaacgtttccgttacggtttacccttcgtaccgtttacccccg

SEQ ID NO: 176320 - DNA, 774 bp, Homo sapiens
  misc_feature: GYAE6OF01DA9FH.17.43.D10.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
tcagcgtagactagcacgaccggtgctcgatttagactagcagtaagggggaggaactgctcagttaggacccagacggaaccatggaagccccagcgcagcttctcttcctcctgctactctggcctcccagatactactggagaaatggtgatgacgcagtctccagccaccctgtctgtttcnccgaggggaacncgcccaccctctcctgcagggccagtcagagtgtgagcagctaacttgcctggtatcagcagaaacctggaccaggcctcccgaggtcctcctctattccgtagtcgggtctcccttaccgaccggtacggggcccgtcgttcgggttacccgtccccgaggtaccccgtaaggttacgttccgggacgggggtcctaacgggggtttcgggggtccgttacggggaaccgtaagggtacgtttcccgaactttcccgtacccgaacctagtaccgacgacctacggtcccgttacggacctagggttaccgttaaggtaaggtttacgttttggaaccgttttaagtttttaacgttaccgttacgttaacctaaacgttaaacgtttaacgttaaacggttacccggggtaccccgggggggtaccccccggggggttagttaacccgggaaccgggtaacgggaacggtaaggggtcggaaacgtacgtaaaccggaaacgtacggttcgggtaggtacgacgaccgtaccctagttccgtacgttacctacttccgttcccgttaaccccgg

SEQ ID NO: 176321 - DNA, 590 bp, Homo sapiens
  misc_feature: GYAE6OF01C5EIZ.17.43.D10.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagcccaccctgtctgtttctccgaggggaacngcccaccctctcctgccagggccagtcagagtgtgagcagcaacttagcctggtatcagcagaaacctggccaggcctcccaggctcctcatctatggtgccttccgaccgacgggccgtctggtcgtcccagccagcttcgagggcaggtgggtcgtgggacaggngttcncgtctcacctatacagcacgcctgcagtctagtaagtagtttgcttagttttacttacgtgttcgtagtactaacttaacgtaaagttaaccggtccggggtacccccgggggggtacgttaccgggtaccgaacgggtaccgtaagggtcggtaagacgtacgaaacgtacggtggtacggcgtcgacaccgtacttcgtcttacttcgtcttcccg

SEQ ID NO: 176322 - DNA, 776 bp, Homo sapiens
  misc_feature: GYAE6OF01C1SH1.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagcccaccctgtctgtttctccgaggggaacgacgcccaccctctcctgcgagggccagtcagagtgtgagcagcaacgttacgcctggtatcagcaacgaaccgtggaccaggcctcccgaggtcctcctcgacttacgtatcggtcgtccttcccgaccggtacgggccgtcgttcgggtccgtcccgacgaccgagtacgtacggacgggggcctaggggttcgggggtccgttagggggaaacctacgggtaacgttccctacgttcctaccgaacctacgtaccgagaccaacgggtcccttgaccgtacgttacgtaaggtaaagtttacgttttggacctttaagtttttaactttacgtcgtaactaacggtaacctaacgtttaacgttaaaccgggttaacccggggttccccgggggggtaacccccccgggggggttaacggtttacccggggaaaccccgggtaaacgggggtaccccggtaaagggggtaacggtaaacggttaaccgtaaaccggaaaacggtaaccggttgggtaccggccgttacgacccgtaaactcgttacgttcgtttacctccgtaccgtttccccg

SEQ ID NO: 176323 - DNA, 808 bp, Homo sapiens
  misc_feature: GYAE6OF01DO1C7.17.43.D10.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (767)..(767): a, c, t, g, unknown or other
  misc_feature (767)..(767): n is a, c, g, or t
  modified_base (799)..(799): a, c, t, g, unknown or other
  misc_feature (799)..(799): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtcctccagcccacctgtctgtttcnccgaggggacncgcccacctctcctgcgagggccagtcagagtgtgagcagtactaacgtttacgccgttaggtactcgaaggtaccaaacggaaaccgtcggacccgtacggcccgttacccgaggtcccttaccgtactacgttaccgttagtcgggttctccccgttaccgaacccggtcggggtccctcggttcgggtacccgttaccccgacggtacccgtaaggtacgtttccgggaacggggtaccgtaggggttcggggtacggtacggggtaccgtaagggttaccgtttaccgtaacccgttcccgtaaccgtaccgtaacgttaccgaacggtcccgtaccggttacccggtacggtaccgtacggtttacgtaacggttaacggtttacgttttacggtaacgtttaacgtttttaccgttacgtacgttaccgacgttaacctaacgtaaacgttaccgtaaccggggtccccggggtaccccgggggtacgttaccggggaaccggtaacgggaacggtagggtacgtacgtaaccgtaacgtaaacggtcgtacggtcgtaccgtnaacccgtcgtactacgttaccgtcttaccgtntacccccgg

SEQ ID NO: 176324 - DNA, 549 bp, Homo sapiens
  misc_feature: GYAE6OF01AY3VS.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctctcctgcagggccagtcagagtgtgagcagcaacttagcctggtatcagcagaacctggccaggctcccaggcctctcatctatggtgccttccaccgagggcccgcttggtcgtccccagcccagacttcgaggggcaggtggggtctggggacagacgttcaccgtctccaccatccagcagccctgcaggtctagaagtatttgctagtttattatgtcagcatataataacgtcgggtacccccggggggtagttccggacgtaacgggaccaagggtcggagacgtacgaaacgacgttggcggtctacgccaccgtacgtcttagtctttcacgttcccg

SEQ ID NO: 176325 - DNA, 636 bp, Homo sapiens
  misc_feature: GYAE6OF01ELZQJ.17.43.D10.1.454.CMB.1.raw
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggacgagccaccctctcctgcagggccagtcagagtgtgagcagcaacttagcctggtatcagcagaaacctggccaggcctcccaggctccncatctatggtgcctttcccaccgagggccgctgggtctccccagcccagtacttcgaggggccagggtcggggtctggggacaggacgtttcacgtctccaccntacagcgacgtcctgcgtacgttctagtaacgttnttttacgactttagttttaattaccgttgttccaggtcctaacgttaattaaacgttaaccggtaccggggtcccccggggggggttaccgttaccgggtaacccgaaggggtaacccgaagggtacgggtaaggacgtaaccgaaacggtacgtaggtcggtccgtacggcctaacccgtacttcgttagttccttccgtacgtttaccccg

SEQ ID NO: 176326 - DNA, 661 bp, Homo sapiens
  misc_feature: GYAE6OF01CVLOL.17.43.D10.1.454.CMB.1.raw
  modified_base (318)..(318): a, c, t, g, unknown or other
  misc_feature (318)..(318): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaaatggtgatgacgcagtctccagccaccctgtctgtttctccgaggggaacgagccacctctcctgcagggccagtcagagtgtgagcagcaacttagcctggtatcagcagaaacctggaccaggcctcccaggtcctcctcatctatggtcgtccttccaccgaggggccncgtcggtcgtccagccagacttcgacgggcaggtcgggtcgtaggggactaggacgttcacgttctaccaccgtaactcgaacgctacgtcctcggtactacgttcgtaggtaagttaagttttcgactaagtttttaacttacgttgttaccaagtacctaacgttaaacttaaacggttaaccggtacccggggggtacccccgggggggtacgttaccggggacccggtaaacggggaccggtaaacgggtagggaacgtaacgtaacgaaacgggtacgtagggtacggtcgtacgaccgtaaccgtagttcctagtttaccctcgttacgttaccccg

SEQ ID NO: 176327 - DNA, 795 bp, Homo sapiens
  misc_feature: GYAE6OF01DHJJW.17.43.D10.1.454.CMB.1.raw
  modified_base (184)..(184): a, c, t, g, unknown or other
  misc_feature (184)..(184): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagcgtagactagcacgaccggtgctcgatttagactagcagtaagggggggaggaactgctcagttaggacccagacggaaccatggaagcccagcgcagcttctcttcctcctgctactctggctcccagatactactggagaaatggtgatgacgcagtctccagccacctgtctgttcnccgagggacngccaccctntccngcagggccagtcagagtgtgagcagcaacgttagccttggtatcgagcaacggaaacctgggacccagggcctacccgaggtcctacctcattcctagtggtcnccttccgaccgagggtccgcgttcgggtccgtacccnggtacccagtacttccggaggggtcctaagggtcgggtcgttaggggactagggtaggttcccacgttaccgtaccgacccgtatacccgaggtaccgaaccgtccgttagtcgtaacggtttacccgtagggttaaacggtttaagtttttcggactttaaacggtttttacgtttaacgtcggttaccgtaagttaccgtaaacctttaagttaaaaccggttaacccggggttacccggggggtaaccccccggggggggttacgttaaccccggggtaacccgggtaaaaccgggggtaaccggtaaggggttacgggtaaaccggtaaacgtaacccggtaaaaaccgggtaacgttacgggttacgggaccttaacgggaacccgttacccgtaacgtttacccggttacgtttaccctttacgttaacgtttccccccgg

SEQ ID NO: 176328 - DNA, 720 bp, Homo sapiens
  misc_feature: GYAE6OF01B3O1P.17.43.D10.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagcccacctgtctgtttccnccgaggggaacncgcccaccctctcctgcagggccagtcagagtgtgagcagcaacgttagccttggtatcagacagaacctggccaggcctccgaggcctcctnactctagtcggtcnccttaccacgacgggcctcgtcggtctcccgagccgtagtattcggacggggtctaggggtcggggtcgtaggggaactaggtacgtttaccactttcctaccgaaccctagtaccgaacgccgtaacggtcccttagggaccttaacggttccgtaaggtaacgtttacgttttacggactttaacggtttttaacttacccgttgttacgacggttaactaacgttaacgttaaaccggtaacccgggtcccggggggtaccccccggggggttagttacccgggaaccggtaaacggggaccgtaaaggggttcggaaaggtaaccgtaaccggaaaacgggttcgttaggacggtccgtacggacccttaacctacggtttcttaccggttacttcgaacccgtttccccg

SEQ ID NO: 176329 - DNA, 1014 bp, Homo sapiens
  misc_feature: GYAE6OF01EUKN5.17.43.D10.1.454.CMB.1.raw
  modified_base (195)..(195): a, c, t, g, unknown or other
  misc_feature (195)..(195): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctcgaggggaacncgccaccctctcctgcgagggccagtcagagtgtgacgcagactaacttacgccgtggtactcgaagtaccaacggaaaacccgttcggaccgaacggtcccttacccgacggtcctccctactacttccgtacgttcgggttccgtcccttacccgaacccggtacgggcccggtccggttgggtcccgttacccgacggtaaccgtacgtacggtttaccggacgggggtctacgggggtttcggggtaccggtaggggaacgtagggttaccgtttaccgtaccgttcccgttacccgaaccttacgttaaccgacgggacccgtacccggttcctacccggtacgtaacggggttttacgttaaacgggtaaaacggttttttcgttttttaaccgggaaccgtttttttaaagggtttttttaaaccgtttacccgggtttacgttaaacccgggtaacttttaaaccccggtttaaaccgtttaaaaaccgggtttttaaaaccgggtttaaaccccccgggggggtacccccgggggggggggggtttaaaccccccccccgggggggggtttaaaggttttaacccccggggggaacccggggttaaaaccggggggtaaaccccgggttaaggggggtaaccggtaaaaaccgggttaacccgtaaaaccccgggggtaaaaacgggtttacccgggtttaacggggacccggtttaacccgtaacgggaacccccttaaaccggttaaccggttttcccgtttaaggtttttaccccccgtaagtttaacccccgttttaccccccggg

SEQ ID NO: 176330 - DNA, 695 bp, Homo sapiens
  misc_feature: GYAE6OF01ENA63.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagcccaccctctcctgcagggccagtcagagtgtgagcagcaacttagcctggtatcagcaagaaacctggccaggcctcccgaggcctcctcatctagtggtcgtccttccgaccgacgggcccgtcgtcgggtcgtccccgagccctagtacttcggacggggctagggtcgggtcgtaggggactaggtacgttccaaccttccgtacacctaattccaagtccgacgtccctggactaggttctaacggtaagttagttttcgacgtttaagttttacttacgttcgttaccgagtacctaacttaagtaacgttaaccgggtacccgggggtacccccgggggggttaacgttacccgggaacccggtaaacgggacccggtaagggtacgggaacggtaacgtaaaccgtaaaccggtaacggttcgggtacggtaccgtacggtaaccgtaccgtacgttaccttacggttccttaccgtccgtttaccccg

SEQ ID NO: 176331 - DNA, 784 bp, Homo sapiens
  misc_feature: GYAE6OF01A1U3V.17.43.D10.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
tcagcgtagactagcacgaccggtgctcgatttagactagcagtaaggggggagggaactgctcagttaggacccagacggaaccatggaagcccagcgcagcttctcttcctcctgctactctggctcccagatactactggagaaatggtgatgacgcagtctcagcctacctgtctcgttctcgaggggacacgcccaccctntcctgcaggccagtcagngtgtgngtcagcaaacttgcctggtactcagctaacgaaacctcggacgacggtaccctaccgacggtccgtaccgtactactccgttagtcggttcgtacctttcccgacggtacgggtcccgtcgtacgggtttaccgcccccgaaggtacccgaacggttaaccttcggggaacggggtaccttaagggggttccggttaccgggtacggggtaaaccctagggttaccgttacccgtacccgttccggttaacccaacccgttattaaccggcgaccgtaacgtcccggtagtaccgtaaccgttacgtacggtaacgtttcgtttaacggacgtttaacgttttaagttaccgttgttacgaacgttctaaaccgtttaacttaacgttacggtaccgggggtcccccggggggtaacttacgggaaccgtaacgggtacgtaacgggtcggtaacgtaacggtaacccgtaaggtaaccggttgggtacggtaccaccggtaccgtacccgtaagggttacccttacggttaacctccgtacccgtttaccccg

SEQ ID NO: 176332 - DNA, 631 bp, Homo sapiens
  misc_feature: GYAE6OF01A48L4.17.43.D10.1.454.CMB.1.raw
  modified_base (185)..(185): a, c, t, g, unknown or other
  misc_feature (185)..(185): n is a, c, g, or t
  modified_base (312)..(312): a, c, t, g, unknown or other
  misc_feature (312)..(312): n is a, c, g, or t
  modified_base (388)..(388): a, c, t, g, unknown or other
  misc_feature (388)..(388): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagccaccctctcctgcagggccagtcagagtgtgagcagcaacttagcctggtatcagcaagaaacctggccaggctcccaggctcctcatctagtgtgccttccaccgacgggccncgtggtcgtcccagccagacttcgaggggcaggtgggtcgtggggacaggtacgttcacgtctcgaaccatacgancgacgtccctgcctagtctagtaagtattttgcttaagttttacttacgttcgtacacgtactaacttaagttaaacgtaaccggttcccgggggaccccggggggtacgttaccgggacccgggaaacgggtaaccggaaggggtcggtaagtaacggtaaccgaaaacggtaccgttagggtacgggtctacggacccgaaccctagttaccgttacggtttcttccgtaacgttcccccg

SEQ ID NO: 176333 - DNA, 759 bp, Homo sapiens
  misc_feature: GYAE6OF01ET1GP.17.43.D10.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
tcagcgtagactagcacgaccggtgctcgatttagactagcagtaaggggggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngccaccctctcctgcagggccagtcagagtgtgagcagcaacttaggcctggtactcgagactaacggaaacctggccaaggtcctacccgaggtcctcctacacttctagtcgggttacgtccttcccgaacccggtacgggggtcccgtcggttcgggtccgtaccccgacggacccgtaaggtacgttccgggaacgggggtcctaagggggttcggggtaccgttagggggaacctagggtacgttccgtaaccgtcccttacgaaacccgtactacggaacggtccgaacggtccccgttagaccgtaacggttacgttaaggaaacgttttgttttacggacttttaacggtttttaactacgtcggtaccgtacgtacctaagttaacttaaaccggtaccgggttcccgggggggacccccgggggttattacccgggaacgtaacgggtaaccgaggggtacgaacgtacgtaacggaaaaccgggtgttagggagtacctacggtacctaaaccgtacgttccgttaagtttccctaactcgttaccccg

SEQ ID NO: 176334 - DNA, 663 bp, Homo sapiens
  misc_feature: GYAE6OF01CWOFT.17.43.D10.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngccacctctcctgcagggccagtcagagtgtgagcagcaacttagctggtatcagcagaactgcagctccagctccnatcatggtncttaccacgagggccncgtggtacgtcccagccagtattcgagggtcaggtgggtcgtgggacaggtagttcactcgtacaccaatcagcacgctgcgtagtctagaaagttagttttgacgttaagttttaacttacgttacggtactaacgtacctaaactttaacttaaacggttaaacccgggttcccggggggtaacccccccggggggggttaacgttacccggggtaacccgggtaaacggggtaaccggtaaaggggttacgggaacggaaacgttaaaccggaaaaccggtaaccggttagggtacgggaccttacgggaccctaaaccgtacgttaccgttacggtttacccttcgtaacgtttacccccg

SEQ ID NO: 176335 - DNA, 924 bp, Homo sapiens
  misc_feature: GYAE6OF01A1ITB.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcaggagtgtgagcagctaacttagcctggtactcgagacgaacgaaaccgtggccaacggcctcccgaggtccttcctacgacttacgtagtcggtctcccgttacccaccggacgggcccggtcttcgggtccgtaccccgacgacccgtaaggtacgttccggaacggggcctaaggggtcggggtaccggttagggggaaccgtaagggttaccggtttaccaccgtttacccgttacccgtaaaccgtacgttaccggaacgtaccggtaaccggtcccgttaaggccgttaacggtttacccggtaaaggttaaacgtttacgtttttaccggtaccgttttaaaggtttttaaaccgtttaccgtttcggttacgtaaacgggttaaccttaaaccgttttaaggtttaaaacccggttaacccgggggttacccggggggtaacccccccggggggggtttaacgggtttacccccggggttaaaccgggaaacccggggggttaacccggtaaaacgggggttaccgggtaaacggtaaacccggtttaaaaaccggggaaaacccggttaaaccggttttcccggggtaacggggttacccgttaacccgggttaaaccccgaaacccgtttaaccggtttacccgggttacggttttaacccctttaccggtccccgttttaaacccccggg

SEQ ID NO: 176336 - DNA, 668 bp, Homo sapiens
  misc_feature: GYAE6OF01AMQGY.17.43.D10.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttcnccgaggggacngccaccctctcctgcagggccagtcagagtgtgagcagcaacttgcctggtatcgagcagaacctggccaggcctcccgaggtcctcctcatcctagtcggtcgcctttacccgaccgtaggggccctcgttcgggtccgttccccaggtccccgaaggtacgtttccggaagggggtcctaaggggttcgggggttcccgttagggggaacctaagggtacgtttccaaccgttcctaccgaccctagttccgaaggccacgcctaggctaagttcgtaggaacgttagttttcggactttaaggttttacttacgtcgtaccagtctaacgttaataaacgttaaccggtccggggacccccgggggtagttccgggaccgaacgggtacccgaagggtcggagtaccgtacgaaaccgtacgtgggtcggacgtcgccaccgtacttacgtcgttccttcgtacgttcccg

SEQ ID NO: 176337 - DNA, 758 bp, Homo sapiens
  misc_feature: GYAE6OF01A7BZF.17.43.D10.1.454.CMB.1.raw
  modified_base (194)..(194): a, c, t, g, unknown or other
  misc_feature (194)..(194): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctcaggggaacngcccaccctctcctgcgagggccagtcagagtgtgagcagcaaacttagcctggtactcagacaagaaaccgtggccaggcctcccgaggtcctcctcactctagtcggtcgtccttccgacgacgggccctcgtcggtccgtacccgagccctaggtacgttccgggaggggtccgtagggttcggggtcgtaggggaacgtaggtacggttccaccgttacctaccgactacgtaccgacgcgtacggtcccgttaggaccgtacgttaccgtaaggtaaacgtttacgttttacgacgttttaacgtttttacttacgttacgtacctaagtaacccgttaacgtttaacgttaaaccggttaacccgggggttaccccgggggggtaaccccccgggggggttaacggtttaccccggggaacccgggttaaaccgggggaccgtaaacggggtacggtaaacgtaaaccggtaaccggtaaaaccggtcgttagggtaccggtacgtacgggaccctaaccgtacgttcgttaccgtttccttacgttaccgttccccg

SEQ ID NO: 176338 - DNA, 717 bp, Homo sapiens
  misc_feature: GYAE6OF01EH1ON.17.43.D10.1.454.CMB.1.raw
  modified_base (197)..(197): a, c, t, g, unknown or other
  misc_feature (197)..(197): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacngccaccctctcctgcagggccagtcagagtgtgagcagactaacttagcctggtactcagcaagaaaccgtggaccaggcctcccgaggtcctcctctactctagtcggtcgtccttccgacccgaggggcccgtcgttcgggtcgtcccgagcccgaggtacttcgggaagggccgtagggttcggggtccgtaggggactacggtacggtttccaccttccgtaccaaccgtatccgacgccgacgtcccgtggtactaacgttcgtaaggtaagtttcgttttacgacgtttaagtttttacttaccgttgtaccgtagtaccctaattaacgttaacggttaaccgggtcccgggggtaccccccgggggggttacgtttaccggggacccggaaacgggtacccgtaaggggtacggtaacgtacgtaaccggtaaaaccggtcgttagggtacggtacgaccgtaccgtaccgtaacgttccggttacgtttcccttcgtccgtttacccccgg

SEQ ID NO: 176339 - DNA, 789 bp, Homo sapiens
  misc_feature: GYAE6OF01D5R18.17.43.D10.1.454.CMB.1.raw
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgttctcgaggggaacagcccaccctctccgtgcgagggccagtcagagtgtgagcagcaattagcctggtactcagcaacgaaccgtcggccaggcctacccgaggtcctccgtactatctagtggtacgtccttaccgaccggacggggcccgtgttacggtcgtccccgaaggtcccaaggtacgttccgggaaggggtctaacggggttggggttcgtaggggaaccgtaaggtacgttcccaaccttccgtacctaaccgattaccgagtcccgagtccctggacctaacggttccgtaaggtaaacgtttacgttttcggaaccgtttaagtttttaaccttacgttcgtacgtaacgtaccttaacgttaaattaaaccgggttaacccgggttaccccgggggggtacccccgggggggtttaaacgtaccccggggtaaccggtaaccgggggtaacccggttaaagggtaaccgggaaagttaaccggtaaaacccgtaaaaccgggttaaccggttacgggtaacggtcccggtaccgtaaaccccgaccggtaacgtttaccgtaccggttttacctaaccgttacccgtttacccccgg

SEQ ID NO: 176340 - DNA, 806 bp, Homo sapiens
  misc_feature: GYAE6OF01CNXYE.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactgggagaaatggtgatgacgcagtctccagccaccctgtctgtttctccgaggggaacgacgcccaccctctcctgcgagggccagtcagagtgtgagcagcaacttaggcctggatcagcaacgaacctggccaggcctccgaggtcctcctcatccttagtcggtcgtcctttcccgaaccgacgggggtcccgcgttcggggtccgtccccctaaggcccgtaaggtacgttccgggacgggggtacgtaaggggttcggggtccggttacgggggaactagggtacggtttacccaccgtttaccgttacccaacccgtacgttccgaacggcctaacggtcccgttacgacgtaacggttacgtacggtaaacgttagttttttcggactttaacggtttttaacgtttaccgttaggttaccgtaacgtacctaaacgtttaaacgtttaaaccgttaaccggggttaccccgggggggtaccccccggggggggttaacgttaccccgggggaacccggtaaacggggggtaccccgtaaaggggttacggggtaacgaaacggttaaccgtaaaaccgggtacgttacgggtacggtccgtaccggtacctaaccgttacggttccttacggtttaccttccgtaccgtttacccccgg

SEQ ID NO: 176341 - DNA, 652 bp, Homo sapiens
  misc_feature: GYAE6OF01BWLOC.17.43.D10.1.454.CMB.1.raw
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcagaaacctggccaggcctccgaggctacctcatctagtggtcnccttccaccgngggccntggtcgtcccagccaggtctcggagggcaggtgggtctgggacagtacgttcactcacacatccgagtcacgtcctgactagttctaggtaaagttagttttggacttaaggttttacttacgttgttacaagtacctaacttaacttaaacgttaaccgggtcccgggggtacccccgggggggttaacgttacccgggaaccggtaaacggggacccggtaaagggtacgggaacgtaaaccgtaaccggtaaaaccggtaacgttcgggtacggtaccgtacggacccgtaaccgtacgttaccgttacgttacccttaccgtacttacccccg

SEQ ID NO: 176342 - DNA, 648 bp, Homo sapiens
  misc_feature: GYAE6OF01AW3A1.17.43.D10.1.454.CMB.1.raw
  modified_base (198)..(198): a, c, t, g, unknown or other
  misc_feature (198)..(198): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgaggggacngccaccctctcctgcagggccagtcagagtgtgagcagcaattagcctggtatcagcaagaaacctgggccaggcctcccgaggcctcctcatctagtggttcgcttcccgaccgagggccgcgtgggtctcccgagcccagtattcgaggggcagggtgggtcgtgggacaggagttcactctcacctatcgagcacgccgtgcgtacgtctagaagtatttgacttagtttacgttacgttgtctagactaataagttaaacgttaaccggtaccggggtaccccggggggtaccgttaccgggaaccggtaacggggtaccggtaagggtacggaacggtaaacgtaaccggtaaaaccggtaaccggttagggttacgggtcgtaccggtaacctaacccgtaacgttaccgttacggtttacccgttaccttaccgtttaccccg

SEQ ID NO: 176343 - DNA, 633 bp, Homo sapiens
  misc_feature: GYAE6OF01E43FA.17.43.D10.1.454.CMB.1.raw
  modified_base (287)..(287): a, c, t, g, unknown or other
  misc_feature (287)..(287): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacacgccaccctctcctgcagggccagtcagagtgtgagcagcaacttgcctgtatcagcaagaacctggaccaggcctccgaggcctccgtnactctagtcggtcgtccttacccgaccggacgggtcccgtcgttcggtccgtccccacggacctaggtacgttacggaggggtccgtagggttcggggtacgtagggactaggtacgttcacctctaccgactatcgacgtcacgctgactagtactagtaattcgtttcgacgtttatttactacgtgtaccgagtactaacttaacgtaacggtaccgggtcccgggggtaccccggggggtacgttaccgggaccggtaacgggaccggtaaggtcgacgtacgaacgtaacgacgtaggtacgcgtacgacgacgtacgttctagttcctgtcccttacccg

SEQ ID NO: 176344 - DNA, 558 bp, Homo sapiens
  misc_feature: GYAE6OF01BZZLT.17.43.D10.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (540)..(540): a, c, t, g, unknown or other
  misc_feature (540)..(540): n is a, c, g, or t
  modified_base (552)..(552): a, c, t, g, unknown or other
  misc_feature (552)..(552): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngcccacctctcctgcagggccagtcagagtgtgagcagcaacttagcctggtatcagcagaacctggccaggctcccaggctcctcatctagtggtgtccttccgaccgaggggccgtcgtgggtcgtcccgagcccagacttcgaggggcaggtgggtctggggacagacgttcactctcacctatcagcagcctgctagtctagtagttatttgactagtttattacgtgtcagtactacttaataagtaaccggtccggggtaccccggggggtacgttccgggaccgaagggaccgaagggtggagacgtacgtaacgtacgtggtcgcgtacgctaccntcgtatcttcgnttcccg

SEQ ID NO: 176345 - DNA, 699 bp, Homo sapiens
  misc_feature: GYAE6OF01AC5CX.17.43.D10.1.454.CMB.1.raw
  modified_base (676)..(676): a, c, t, g, unknown or other
  misc_feature (676)..(676): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagctaacgttagccttaggtatcaggcaacgaaacctggccaggcctcccgaggcctcctcatctagttggtctccttccaccgacggggccgtcgttggtcgtcccgacgcccgaagtagttcggacggggctagggtcggggtcgtagggaactagggtacgttacgacctccgttacgacccgtatccgaggtaccacgtccctacggcctacggttacgtaggtaacgttagtttttacggactttaacggtttttaattacgttacgttacaccgtaactaaccgtttaattaaacgtaacccgggttcccgggggtacccccggggggttagttaccgggaaccggtaacggggtaccgtaaggggttacggacgtaacgtaacggtaaaccggtacgttagggtacggaccgttagaccgtaccgtattcccgttnttaacccgttcaccgtttccccg

SEQ ID NO: 176346 - DNA, 603 bp, Homo sapiens
  misc_feature: GYAE6OF01D1JG7.17.43.D10.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagcccaccctntcctgcagggccagtcagagtgtgagcagcaacgttagcctggtatcagcagaaacctggccaggctcccaggctcctcatctatggtgccttccaccgagggccgcgtgggtcgtcccagcccagtacttccgaggggcaggtgggtctggggacagtaggttccacttcnccgaacctntcgagcagcctgcagtctgtaagtnttttacgcttaagttttacttacgtagtccagtactaacttaagtaacgtaacggtcccggggaccccggggggttacttaccgggacccgtaaacgggacccgtaagggtacggagtacgtacgaaacgtacgtggtacggtacttcggaccaccgtacgttacgttagttcctcgtcgttcccccg

SEQ ID NO: 176347 - DNA, 678 bp, Homo sapiens
  misc_feature: GYAE6OF01ALIBH.17.43.D10.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
tcagcgtagactagcacgaccggtgctcgatttagactagcagtaagggggaggaactgctcagttaggacccagacggaaccatggaagccccagcgcagcttctcttcctctgctactctggctcccagatactactggagaaatggtgatgacgcagtctccagccacctgtctgtttcnccgaggggacngccacctctcctgcagggccagtcagtagtgngagcagctaacttgctggtatcagcaagaaccgtggccacggcctcccgaggtcctcctctacttcgtagttcggtctccctttacccgaccggacggggtcccgtgttcgggtcctacccgagccgtagtacgttcggacggggtctaggggtcgggtacgtaggggactaggtacgtttacaccgttactacctaacgtactcgaacgtccacgtccgtgacgtacgttctaggtaagtttagttttcgacgtttaagtttacttcgttagtacgtaacgtctaaacttaacgtaacgttaacccgggtcccgggggtaccccgggggttacgtaccgggtaaccggaacgggaccgtaagggtacggacgttaaaccgaacgtaaaccggtacggtggttacggcgtacgcctaccgttcttacggttacttccgttcgtcgttccccg

SEQ ID NO: 176348 - DNA, 764 bp, Homo sapiens
  misc_feature: GYAE6OF01E2EE2.17.43.D10.1.454.CMB.1.raw
tcagcgtagactagcacgaccggtgctcgatttagactagcagtaaggggagaactgctcagttaggacccagacggaaccatggaagccccgagcgcagcttctcttcctcctgctactctggcctcccagatactactggaagtaaactggtgattggacgcagtctccagccaccctgtctgtttccaccgaagggacacgcccacctctccgtgccgacgggccagtcaggtacgtgtaggacgacgacggtactaaaccgttcggtaccgttaggtacgtacgaacgaccgtaacggaaacccgtcggtacccgacggtccctacccgtacggtccgttacctactacgttacgttacgttcggttaccgtaccgttacccgaaccggtaccggtccgtcggttcggtacccgtaccgtaccggtaccgtaagtacgttacggacgggtacgttacggtcgggttacgtacgggtaactacggtacgttaccgaccgttacgtaccgtactacgtacgtaacgacgtaccgtacgtacgtacgtaccgttacgtaagttaacgttgtttacgtagtttacgtttacgttacgttacgtaccgtaacgttactaacgttaacgtaaccgggttacccgggtccggggtaccccgggtacgtacccggacggtaacggtacggacggtacgtaacgtaacgtaacggtaacgtcgttaggacgtcgtacgaccgacgtactcgtattcctcgtccgtaccg

SEQ ID NO: 176349 - DNA, 592 bp, Homo sapiens
  misc_feature: GYAE6OF01CJ03H.17.43.D10.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggacngcccacctctcngcagggccagtcagagtgtgagcagcaacttgcctggtatcagcagaaacctggccaggcctcccgaggccttccncatctatggtgccttccaccgagggcccncgtggtcgtcccaggccaggnttcgagggcaggtcgggtctgggactgagttcaactctacactatcacgcacgctgctacgtctagtaagtatttgcttagtttattactgtacagtctaacttataacgtaaccggtccggggtacccccggggggtacgtttaccgggaccgtaacggggaccgaagggttaggaacggtacgtaaccgtaaacggtacgtgggtaacggtcgtcggaaccgacctacgttactacgttcttccggtactttccccg

SEQ ID NO: 176350 - DNA, 991 bp, Homo sapiens
  misc_feature: GYAE6OF01D77GJ.17.43.D10.1.454.CMB.1.raw
  modified_base (144)..(144): a, c, t, g, unknown or other
  misc_feature (144)..(144): n is a, c, g, or t
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactgganaaatggtgatgacgcagtctccagcccacctgtcttgtttcnccgaggggacncgccacctctccngcagggccagtcgaggtagtgtagagcagcctaacgtttacgccgttaggtactcgaacgacgaaacggtaaaccgtcgggacccgacgggtccctacccggaacggtccttacccctactaacgtttccgtaggtttcgggttaccgttcccgtttaccccgacccgggtacgggggtccccgtccggttccgggttaccgtacccccgaacggtacccgtaagggtaccgtttaccggggaagggggtccgttaacggggttccgggggttaccggtaacggggtaaccgtaacgggtttacggttttacccaaccgttcccgttaaccaacccgtagtacccgtacggtaacctccgggtacccgtaggtaccgttaacgggttaccgttaaggttaaacggttttccgttttacggtaacccgttttttaaaggttttttaaccgttaccgtttaccgggttaaccgtaaaccgtttaaccgtttaaaccgttttaaaacggtttaaaccccggggtttaaacccccggggggggttccccccggggggggggtaaacccccccgggggggggttttaaccgtttaaccccggggaaacccggggttaaacgggggtaacccgggtaaagggggttacgaaaccggttaaaccggtaaacccgggtaaaaagggttcccggttacggggtaccggtacccgttaaccgggaccccttaaacccggttactttccccggtttaaccgttcccttttaccgtaccccggttacccccgg

SEQ ID NO: 176351 - DNA, 771 bp, Homo sapiens
  misc_feature: GYAE6OF01EBKGT.17.43.D10.1.454.CMB.1.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaaatggtgatgacgcagtctccagccaccctgtctgtttctaccgaggggaacgagccaccctctcctgcagggccagtcagagtgtgagcagcaacttagcctggtatcagacaagaaacctggccaggcctccgaggctcctacatctatggtnccttccacgacgggccncgttggcgtccagccagagttcgagggctaggtcgggtgtgggacaaggtagttccacgttcctacaaccctattacgaacggtaccaaccgtcccgtaggccttaaggttacgttaggaaaagtttagttttacggttacgtttaaggttttaactttaccggtacgttacgaacggtaccctaaaacgtttaacgttaaaaccggtttaaccggggtaccccgggggggttacccccccgggggggggttaaccggtttaccccggggaacccgggtaaaccgggggtaacccggtaaaacgggggttacggggtaaaaccggtaacggttaaaaccgaaaaaccgggtaaaaccggttacggggttaccgggaacggttaacggtacccgtaaacccgtacgtttaccgtttaccggtttacctttacccgttacgtttaaccccccgg

SEQ ID NO: 176352 - DNA, 855 bp, Homo sapiens
  misc_feature: GYAE6OF01CY925.17.43.D10.1.454.CMB.1.raw
  modified_base (145)..(145): a, c, t, g, unknown or other
  misc_feature (145)..(145): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactacgtgganaaattggtgatgacgcagtcctccagccctacccgtgttcttagtttccgacggaagggggaaccaccgccctacccctccgtcctcggaccgacgggccctagtacgagtacggtgtacggacgaccgaacggtaccttaaaaccgtttcggtcccgtttagggtaacgttaccgaggaacccgaaaccggtaaaaccggttccgggaacccgtaaccgggtccctacccggacggttccctccgttatttaacgttttcggttacggttccgtacccgttaccggaccggtaccggggtcccgttacggttaccgggtccgttacccggacgtacggtaacgtacgtacgggacggggtacgtaggggttccgggtacggtacgggtacacggttaccgttacgtaacccgttctaaccgaaccctagccggtacgaccgtaccgtcccggtacggtaacctacggtaacgttaggtttaaacgttgtttttaaacccgcgtttaaggtttttaaccgtaacgtcgtacgaccgttaacctaacgttaaaggtaacccgttcgggggttaccccgggggacccccggggtttagtacccgggaacggtacccgggtaagggtacggaaggtacctacgggtaaaccgtaaggccgttgggcttaacgcgacgtaacctgttaccgtcgttatcctacgtcccggtacc

SEQ ID NO: 176353 - DNA, 569 bp, Homo sapiens
  misc_feature: GYAE6OF01DUA0W.17.43.D10.1.454.CMB.1.raw
  modified_base (204)..(204): a, c, t, g, unknown or other
  misc_feature (204)..(204): n is a, c, g, or t
  modified_base (561)..(561): a, c, t, g, unknown or other
  misc_feature (561)..(561): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctntcctgcagggccagtcagagtgtgagcagcaacttgcctggtatcagcagaaacctggccaggctccagctctcatctatggtgccttccgaccgagggcccgcttcggtcgtccccgagcccgagacgttcgaggggctaggtgggtctgggacaggattcactctacaccatcagcagcctgcagtcgtagaagtatttgctagttttacttactgtcagtactaactaattaaacgtaacgtccggggtacccccgggggggtacgtttaccggaaccgtaacggggacctaaagggtcggaagtacaacgaaaacgtactaggtcggctagaccacgtactcgttagtccttnacttcccg

SEQ ID NO: 176354 - DNA, 733 bp, Homo sapiens
  misc_feature: GYAE6OF01DFW8L.17.43.D10.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggacngccaccctctcctgcagggccagtcagagtgtgagcagcaacttagcctggtatcagcagaacctggaccaggcctcccgaggcctccgtacatctagtggtcnccttcccgaccgagggcctcgtgggtctcccagcccaggtacttcggaggggtcctaagggtcgggtctaggggaaccaggtacgttccacgttcctaccgaaccctagtccgacggtaccgtaacgtcccgtacggtacctaacggtttaccgttaggtaaacggtttaagtttttacggtacgtttaagtttttaacgtttaccgttacgttaccgtaacgtacctaacgttaagttaaaccgttaaccggggtcccggggggtaccccccggggggggttacgtttacccggggaaccggtaacggggaccggtaacggggttacgggaacggtaaccggtaaccgtaaaaccgggtacgttagggttacggccgtacgtacccgtaaccgttacgttacccgttacgttccttaccgtcgttaccccgg

SEQ ID NO: 176355 - DNA, 762 bp, Homo sapiens
  misc_feature: GYAE6OF01CH5DA.17.43.D10.1.454.CMB.1.raw
  modified_base (183)..(183): a, c, t, g, unknown or other
  misc_feature (183)..(183): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgttcnccgaggggacacgcccacctctcctgcgagggccagtcagagtgtgagcagactaacgttacgccgttggtatcgagacgaacgtaaacccgtcgggaccgacggtccctcccgacggtccttcccgtcattccgtaggttcggttccgtccgttaccccgaacccggacggggtcccgtccgttcggtccgttaccccgaggccaaggtacgttcgggacgggcgtaggtcggggtcggtacgggtacgtacggtacgttcaccgttcctaccgacctagtaccgacgtcgaccggccgtcggaccgttacggtacttaaggtaacgtttagttttcggaaccgttttaggttttacttaccgttagaccgtaagtacctaacgttaacgttaaacggtaacccggggttccccggggggtaccccccgggggtttacggttacccgggaaccgggtaaacggggtacccggtaaggggtaacgggtaaacgacgttaaacccggaaaacgggtacgtggggccgttcgccgtaacacccgttagttccgttacgttcccttacgtcctttaccccgg

SEQ ID NO: 176356 - DNA, 648 bp, Homo sapiens
  misc_feature: GYAE6OF01CC0IK.17.43.D10.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtcctgtttcnccaggggaacagccaccctctccngcagggccagtcagagtgtgancagcaacttagcctaggtatcaagcaagaaacctggaccaggcctccgaggcctacctcagtctagtggtcacttacccaccgacgggtcccgcgttgggtctacccgagtccgaaggtcttacgacggggtcaagggtttcgggacttggggaacctaaggtacgttcaactcctaacgacctagtcaacgcaacgctagcaagtctagaagttagtttcattagttatacgtgtacacgtactaacgttaagtaacgttaaccgtccgggggtaccccccggggggtaacttcgggaacccggtaaacgggaccgtaaagggtggaaacgtagtaaaccgaaaacggaaccgttgggacggttcgacggtactaacccgacgtttacgtacgttacttaccgtactttcccgg

SEQ ID NO: 176357 - DNA, 831 bp, Homo sapiens
  misc_feature: GYAE6OF01BSZSH.17.43.D10.1.454.CMB.1.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (385)..(385): a, c, t, g, unknown or other
  misc_feature (385)..(385): n is a, c, g, or t
tcagcgtagactagcacgaccggtgctcgatttagactagcagtaaggggaggaactgctcagttaggacccagacggaaccatggaagccccagcgcagcttctcttcctcctgctactctggcctccagatactagtggagaatggtgatgacgcagtcnccagcccacctgtcttgttccncggaagggacncgcccacctctccgtgcgacgggcctagtacaggtagtggtagacgcgacgactaacgttcggcctaggtacacgagtacaacggaacgtcggccgacggtccacccgacggtcctcctacgtattaccgtaggttcggtaccgtcccgttaccggaccggtcgggtccgtcggtaccgttccgacccgngtaccgtagtacggtacggacgggtcgtaggggtcgggtacggtggtaaccgtagttacgtacctacgtcctaccgtaacgtcgtaccgacgtccacggtaccctagtacgacgttaccgttaaggtagttttaacgttacggtttacgtttaacgttttaataccgggtttactaccgtaacgttaacttaaaccttaaacgggttaacccgggttaccccggggggtacccccggggggtttaaccccgggggttacggtttaaaccccgggaaacggggggttaaaccggtaaccggggttaaccggggtaaacggtaaaccgttaaaccggaaaccggggttaaaaaccgcggggttaacggtccggtaaacggaccgtttacccgaaaccgtttcgttacccgttaacggtttccccgttagttacccccggttaacccgg

SEQ ID NO: 176358 - DNA, 747 bp, Homo sapiens
  misc_feature: GYAE6OF01BF7UV.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctcagccacctgtctgttctcgaggggacacgccaccctctcctgcacgggccagtcagagtgtgagcagactaacgttacgccgtaggtatcgagacgaacgtaaaccgtcggaccgacggcctacccgaggtccctcctacacttcgtagtcggtcgtccttacccgaccggacggggtccctcgtgggtaccgtacccgacggtcccgagtacgttccggaggggtcagggtcgggtcgtcgggactaggtacgtccacgtctaccaacgtctacacgcgtacgcctagtaccgtagttacgtagtaagttacgttttagactttaaggtttactaccgttagtaccgagtaccttaacgttaattaaaccggttaaccccgggggttacccgggggggtaccccccggggggtttacggttacccgggaacccgggtaaaccggggtaccggaaacgggggttaccggaacggttaaaccggtaaacccggtaaacgggtaccgttaggggttaccgaccgttaccggaccctacgttacggttcctttaacggtttcccttacgtacccgtttaccccgg

SEQ ID NO: 176359 - DNA, 742 bp, Homo sapiens
  misc_feature: GYAE6OF01BA8HG.17.43.D10.1.454.CMB.1.raw
  modified_base (196)..(196): a, c, t, g, unknown or other
  misc_feature (196)..(196): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacngccaccctctcctgcagggccagtcagagtgtgagcagtacaacttacgcctggtatcgagcaagaaacctggacccaggcctcccgaggtcctcctcactctagtcggtgtccttccgaccgacgggtccgcgttgggtccgttcccgacgtcctagtacgttccggaggggtactaggggttcggggtccgttaggggaaccgtagggttaacgttccgtaaccgttccgttacccaaccctacgttccgaaacgccgtaaccgtcccgtagtccgtaagttcccgtaaggtaaacgtttgttttacgactttaaggtttttactacggttgtaccgtagtaccgtaacctttaacgtaaaggttaccccgggtcccggggggttacccccgggggttaagttcccgggaaacccgggtaacggggtacccggtaaggggtcggaaccgttaacgtaacccggaaacggtacggttacggacgggtctaccggtacctacccggtacttcggttacccgttactttcctaacggtttccccccg

SEQ ID NO: 176360 - DNA, 822 bp, Homo sapiens
  misc_feature: GYAE6OF01A9DZM.17.43.D10.1.454.CMB.1.raw
  modified_base (197)..(197): a, c, t, g, unknown or other
  misc_feature (197)..(197): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtcttgttctccgaggggaacngcccacctctcctgcgagggccaggtcaggtagtgtgagcagactaacgttgcctggtatccgagacaagtaacctggacccgacggcctacccgaggtccctcccgtacacgtttacctagttcgggtacgtcccttacccgaccggtacggggcccgtacggttcgggttaccgtaccccgacggtaccctaaggtacgtttaccggggaacggggtaccgtaggggttcggggtacggtacggggtacggtacgttacggtttcctaacgttccgttaaccgaccctagttccgaacggtcctaaccgtccggtacgtacgacgtttagtacggttaacgttcgttttacggaactttagttttacgtacttacggtactaacgtactaacgtttagtaaaccggttacccggggtacccggggggtaacccccgggggttattaccccggggaacccgtaaacgggggttaacccgtaacgggggttacggtaacccgtaaaccggtaaacccggtaaaacgggtaccggttaggggtacccggtacgttaccccggaaccgttaacccggttcgtttacccggttactttaccccgtttaccgtaaccctttcccccggg

SEQ ID NO: 176361 - DNA, 707 bp, Homo sapiens
  misc_feature: GYAE6OF01E4YHU.17.43.D10.1.454.CMB.1.raw
  modified_base (185)..(185): a, c, t, g, unknown or other
  misc_feature (185)..(185): n is a, c, g, or t
  modified_base (224)..(224): a, c, t, g, unknown or other
  misc_feature (224)..(224): n is a, c, g, or t
  modified_base (477)..(477): a, c, t, g, unknown or other
  misc_feature (477)..(477): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagccaccctctcctgcaggccagtcagngtgtgagcagcaacttacgccgtggtatcagacaacgaaacctggccaggcctccgaggtcctcctcatcgtagtcggtcgtccttaccgaccgacggggtcccgtcgttcgggtaccgtccccgacgaccctaaggtacgttcggaacggggtcaagggtttcggggtacgtaggggaactaggtacgtttcaccgttcgtaccaccagtaccaggtaccacgtccttcgacgtacgttacgtagtaagttnttttacgacttagttttaacttcgtcgtactaagaccttaagttaacgtaacgttaaccgggtcccgggggtaccccggggggttaacgttcccgggaacccggtaaacggggaccgtaaaggggtacggaacggaaaccgttaaacgaaaaccgggtacgttgggtaacgggtccgtacgaaccctacgttacgtaccgtttggtaccttttcccgaacgtttcccccg

SEQ ID NO: 176362 - DNA, 748 bp, Homo sapiens
  misc_feature: GYAE6OF01DK4US.17.43.D10.1.454.CMB.1.raw
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
tcagcgtagactagcacgaccggtgctcgatttagactagcagtaagggggaggaactgctcagttacggacccagacggaaccatggaagccccagcgcagcttctcttcctcctgctactctggctcccagatactactggagaaatggtgatgacgcagtctccagccaccctgtctgttcncgagggacgagccacctcncctgcaggccagtcgagtagtgtgacgcagactaacttacggccttggtactcgacgacaaacggtaacctcggacccaacggtcctacccgacgggtcctcccgtacgtacttacgttacggtcggtaccgtaccgttaccccgaaaccggtacggggcctacggttcgggtaccgtacccgacggacccgtaaggtacgttaccgggagggtacctaaggggttcggtacggtacggaacgttaacggtacgttaccgacctttccgtaaccgaacgtacgtacgaccgtacgtaaccgtcccgtacgaacgttacggtaccgttagtaaacgtttacgtttacgtacgtttaagttttaccgttaacgtagttaaccgtaagtccctaaagttaacgtaaacggttaccgggtcccggggtacccgggggtaccttacgggaccgtaacgggacgaagggtacgacgtaccgtaacgaaaccggtagtaggtacgaccgagtacccacgtcgttacgtacgttccgtacgtcgttaccccg

SEQ ID NO: 176363 - DNA, 740 bp, Homo sapiens
  misc_feature: GYAE6OF01BQPIU.17.43.D10.1.454.CMB.1.raw
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgttcnccgaggggacagccaccctntccgtgcagggccagtcagtagtgtgagcacggtacaacgttacgcctgggtatcgacgcaagaacctggccaaggtcctacccgaggtcctaccctnactctagtcgggtcnccctttaccaccggtacgggccctcgtgggtacctcccgaggcctaagtactcgaacggggtcaggttgggtacctaggggtaccaaggtcgttactaaccgtntaccgtaaacctnttaccgcgtcgtacgccgttacaccgtaaggtcccttaagaacgttacgttttcgacttaagttttaactaccgttaggttaccaggttacctacgttaaaacgtaacttaaccccgggtagggggaacccccccggggggttattacccgggtaaacccgtaaccggggttaacccggaagttacggggtaacggtacttaaaccccggtaaacgggttaaacccgtgggttaacccggtcgttacgggaaccctaacctttactaaccgggtttcttaaacccggtttcgtaaactttcccccgg

SEQ ID NO: 176364 - DNA, 769 bp, Homo sapiens
  misc_feature: GYAE6OF01CT9FG.17.43.D10.1.454.CMB.1.raw
  modified_base (233)..(233): a, c, t, g, unknown or other
  misc_feature (233)..(233): n is a, c, g, or t
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactacgtggagaaatggtgatgacgcagtcctccagccacctgtctgttctccgagggacgcgccctacctctctgcacggccagtcagtagtgtggnacagcgtaactagcctaggtactcacgacaacgaaccgtcggaccgaaccggtccncccgaggtccttcctactattacgtntcggtacgtcctacccgaccggtacgggcctcgttaccggtccgtaccccgagtaaccggtagtacggtttaccgggaggggtacgttaggggttccgggggttcgtaagggaacgttacggtacgtttaccgacctaccgtaccaccgtacgtactcggacctaaccgtcgtacgtacgtaacgtccgttaaggtaacgtttctttaggtacctttaaggtttaccgtttagtacggtaccttacggtaacttaaacgtaaaccgtttaccggtaacccgggggttccccggggggtaaccccgggggtacgtttacccgggaaccgggtaaaccggggtacggtaaggggtaacgtaacggaccgttaaaccggaacggtaacgggttcggtacgtccggaccttacccggacctagttccggttatcccgggttactcccggtttaccccg

SEQ ID NO: 176365 - DNA, 762 bp, Homo sapiens
  misc_feature: GYAE6OF01C4VD4.17.43.D10.1.454.CMB.1.raw
  modified_base (185)..(185): a, c, t, g, unknown or other
  misc_feature (185)..(185): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgagggacgacgcccaccctctcctgcgagggccagtcagagtgtgagcagactaacgttagccgtaggtatacagacaacgaaaccgtcggaccgacggccctacccgacggtccttcccgtctacttacgttagttcgggtcctccgtttacccgaacccggcggggtccgtcggttcggttccgtaccccgacggcccaaggtacgttaccggacggggtccgtaggggttcggggtacggttaggggaacgtacggtacgttacccgactttcccgacctaacccgtacgtaccgacgacccgtaccgtccgttacggacctacggttaccttaggtaacgtttacgttttcgtaacgtttacgttttaacttcgtacgttacctacgtaccttaaacgttaacgttaaaccggttacccggggtaccccggggggtacccccgggggttaacgtacccgggaacccggtaaacgggaccggtaagggtccggtaacgtaacggtaaccgtaacggtacgttcgggtacgacgtccgaacctctacgttcttacgttactcgtccgttcccg

SEQ ID NO: 176366 - DNA, 691 bp, Homo sapiens
  misc_feature: GYAE6OF01EKLNL.17.43.D10.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (343)..(343): a, c, t, g, unknown or other
  misc_feature (343)..(343): n is a, c, g, or t
  modified_base (570)..(570): a, c, t, g, unknown or other
  misc_feature (570)..(570): n is a, c, g, or t
tcagcgtagactagcacgaccggtgctcgatttagactagcagtaagggggaggaactgctcagttaggacccagacggaaccatggaagccccagcgcagcttctcttctcctgctactctggctcccagatactactggagaatggtgatgacgcagtctccagccctacccttgtcttgtttctccgaaggggaacacgcccacccttcgtcctgccagggccagtcagngtgtgancagcaacttgcctggtactcgagcaaggaacctggaccaggcctcccgaggtcctcctacatctagttcgggtctccttccacgtacgggcctacgttggtcncccagtccaaggttctcgagggtccagggttcggacgtacgggactacggtacgttccacgttcgtaccgacccgtattaccgacgtacgtacggtcccttaggaccgttacgttaccgttaagtaacgtttacgtttacgtacgtttaagtttttaccgtacgtgttaccacggttaacctacggttaagtaaccgtaccgggtcccgggggtaccccgggggttnttaccgggaacccgtaaggacccggtaagggacgtaacgtacgtaaacgtaacggtacgtggtacgtacgtacgaacccgtacccgtacgttccgtacgttacctcgtacccgttaccccg

SEQ ID NO: 176367 - DNA, 880 bp, Homo sapiens
  misc_feature: GYAE6OF01DY6SO.17.43.D10.1.454.CMB.1.raw
  modified_base (156)..(156): a, c, t, g, unknown or other
  misc_feature (156)..(156): n is a, c, g, or t
  modified_base (168)..(168): a, c, t, g, unknown or other
  misc_feature (168)..(168): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
  modified_base (572)..(572): a, c, t, g, unknown or other
  misc_feature (572)..(572): n is a, c, g, or t
  modified_base (841)..(841): a, c, t, g, unknown or other
  misc_feature (841)..(841): n is a, c, g, or t
tcagcgtagactagcacgaccggtgctcgatttagactagcagtaaggggaggaactgctcagttaggacccagacggaaccatggaacgccccagcgcagcttctcttcctcctgcctactcgtggcctcccagatactactggagaaatggtanatgacgcagtcnccagcctacctntnttgtttcaccggaagggaacacgtcccaccttctaccgtcgaccgacgggtaccagtactaagggtnttcgacgaggacctaagggtaacctaaacgtttccgggtacttcgggtaactacgacgtacggaaaccgtaacccgtacgggtaacccgtacggttccgtaccggaccgttccctacccctacgttaactttccggtaacggtttcgtacccggttaccgtacccggaacgggcccgggttccgtccggttaccgggttaccctcggaacccgttacgacgttaccgggttagggacgggtaacgttacgggggttcgggttaccggaaggtacggttaacggtccgtttaccgaacctacgttaacccgaccaccggttaanacccggtaacgtacgccggtaactaccgtacggttacgttacggtttaaacgtttacgtttacggttaagtttttaccgggtttaactttcgttacgttaacgtaacgttaactaaccgttaaataaacccgggtcggggtaaccccggggtaccggggtaccttaccggggaaccgggtaacgtagggtacggtaaccgaacgggttaacgtaaaccggtaacggttacgacgggttacggacgttaacccggaccttacccggtttntaacccggtttacttccgggtacccttccggtaaccccg

SEQ ID NO: 176368 - DNA, 938 bp, Homo sapiens
  misc_feature: GYAE6OF01B0W52.17.43.D10.1.454.CMB.1.raw
  modified_base (198)..(198): a, c, t, g, unknown or other
  misc_feature (198)..(198): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtcttgtttcctccgaggggacncgccaccctctcctgcgagggaccagtcaggagtgtgacgcagactaacttgccttggtatcgagacgtaagaacctcggaccgacggtcctacccgacggtcccttcccgtacacttacgtacgttcgggttaccgtcccgtttaaccccgaccgggtacccgggggtcccgttcccgggttacggggtttacccggtacccccgaacggtccccgtaaagggtaaccgtttacccgggggaacgggggtcgtaacgggggtttcgggggttaccgtaagggggggaaccgtaagggtttacccggttacctaccgttacccgtacccgtaaaccgtacttaccgaacggtacccgtacggtacccttcggaccgttacggttacccgttaagggtaacgttttacgttttacggtaaccgtttttaaggtttttaccgttaaagtttccgggaaccttaacgtacccgttaaaaccgttaaacgtttaaccgggttaaccccgggggttacccccggggggggttaacccccgggggttaaccggtttaccccggggaaacccgggttaaaccgggggggtaacccttaagggggggtaaccgttaaaccggaaaccgttaacccgggaaaaacgggttaccggttacggggtacgggtaacccgtacggtaaccccgtaacggttacctttaccgggtttaccgttaacccgtttaccgttccggtttaaccccccg

SEQ ID NO: 176369 - DNA, 838 bp, Homo sapiens
  misc_feature: GYAE6OF01BXJAR.17.43.D10.1.454.CMB.1.raw
  modified_base (203)..(203): a, c, t, g, unknown or other
  misc_feature (203)..(203): n is a, c, g, or t
  modified_base (775)..(775): a, c, t, g, unknown or other
  misc_feature (775)..(775): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccctaccctgtcctgtttccgaccgaaggggaacncgccctacccttcctccgtgccgtacggccgtagtcgaagtagtgtacgagaccgtagtaccgtaaacgtttacgccgttagggtaactaccgtaacgaaccggtaaacgtaacccggtcgggaccctacgggtccctacccgacggtccctaccttacacgttacgtaggttcggttacgtccgttacccgaacccgggtaccggggccgttccggttcgggtcccgtaccccgtagacccgtaaggtacggttccggggagggtccggttaggggttcggggttaccggagggtaacgtacggttacgttacccctaaccgtactacccgaaccctactccggtacggtaccgtaccgtccgttaccgtaacgttacggttacttaagggtaacgtttacgtttacgacgtttttaacggttttaacctacggttccgtaaccgtacgttaaccgtaaccgttaaagtaaccggtaccggggtacccggggggtaccccggggttactacccggggaaacggtccgggtaaacggtacggtaacggaacggtaccgtaaacgtaccgggnttacgggacctcgtaaaccgtccgacgttcgttaccgttatccctttaagccgtttaaccccg

SEQ ID NO: 176370 - DNA, 786 bp, Homo sapiens
  misc_feature: GYAE6OF01AE57Y.17.43.D10.1.454.CMB.1.raw
  modified_base (319)..(319): a, c, t, g, unknown or other
  misc_feature (319)..(319): n is a, c, g, or t
tcagcgtagactagcacgaccggtgctcgatttagactagcagtaagggggaggaactgctcagttaggacccagacggaaccatggaagccccagcgcagcttctcttcctcctgctactctggctccagatactacgtggagaaatggtgatgacggcagtctccacgccaccctgtcttgtttccgtccgaggggaacgacgcccgtaccctctccgtgacgacgggccagtcaggagtgtgacgcgagacctaacgttacgccgtggtactcagcaacggaacctcggccgacggtcctacccgaggtcctcctnacgttcgtacgtcggtcgtaccttacccgaccgggtacggggccgtcggtacggtccggtaccccgacgtaccgtacggtaacgttcgggacggggtcgttaacggggtcggggtacgtagggggtaccgtaagggtcgttaccgtacgttaccctaaccgaacctacgtaccacgggtacccacggtccctaggtacccgtagttaacgttacgtaaagtttacctttttaaacgagtttttaacttacggtcttacgaacgtactaacgtttaagtaacccggtcgggggtaccccggggtacccgggggttacctaccggggtaacggaaaccgggtacggtaagggtaccgaaggtaccgtaaaccggtaaaggtaacccggtgggtttacgaccgggttccggaccctacgttacgtttccggttactacccgtttaccccgtcgtttccccgtacccccgg

SEQ ID NO: 176371 - DNA, 779 bp, Homo sapiens
  misc_feature: GYAE6OF01C0LAH.17.43.D10.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (735)..(735): a, c, t, g, unknown or other
  misc_feature (735)..(735): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtcctccacgccaccctgtcttgtttcctccggaggggacncgccctacctctccngcgacgggccagtanagagtgtgagnacgactaacttcgccgtggtanacacgctaaacgaaccgtggaccacggcctccggacggcccttccactactgttacgtgggtctacccgttacccgaaccggcggggtcccacggttcggtacccggtcccagaccgtaggtaggttccgggagggtccgtaggggttcggggtacggtacgggtactacgggtacttaccgacttcctaaccgacctagtcgtaacgcgtaccgcccgtagtaccgtagttaccgtacggttaagttactttaggtacgttttaacgtttacgtttacgtacgttaaccgtaccgtacctttaaacgttaaacggttaaaccggttaccccggggggtaccccggggggttaccccggggggtaaccgttacccggggaaacccgggtaaaccgggacgggtaagggttaacgggaaccgtaaacggttaaccgaaaacggttcggtagggtacgacggtccgtaaacnccggttattccgttaccggttccttaccggttctaccccccggg

SEQ ID NO: 176372 - DNA, 886 bp, Homo sapiens
  misc_feature: GYAE6OF01A8KX0.17.43.D10.1.454.CMB.1.raw
  modified_base (407)..(407): a, c, t, g, unknown or other
  misc_feature (407)..(407): n is a, c, g, or t
  modified_base (798)..(798): a, c, t, g, unknown or other
  misc_feature (798)..(798): n is a, c, g, or t
tcagcgtagactagcacgaccggtgctcgatttagactagcagtaagggggaggaactgctcagttaggacccagacggaaccatggaagccccagcgcagcttctcttcctcctgctactctggctccagatactactggataaatggtgatgacgcagtctcgagccacctgtctgttctcgagggacacgccacctctcctgcgacggccagtcgagtagtgtagacgcacgactaacgttagccgtaggtactcgaacgacgtaacggtaaccgtcggacccgtaacggtcctacccgacggtcccttaccctacaccgttccgttaggtcggttccgtaccttacccggaaccggtcgggccgttaccgtcgggtccgtaccccgaggtcccgaaggttacnccgggtacgggtacgtacgggttcggggtaccgttaggggaaccgtaaggttaccgtttccgaaccgttacccgttaccgaaaccctacgtacggaaccgttgacccggttacccgtgacccgttagtacgtttacgggtaaacgttttcgttttaccgggacttttaaacgttttacttaccggtttagtaacccgtaacggttaacttaaaaccgttttaacgtaaaaccccgggtttttcccggggggtaacccccgggggggttacccccgggggttaaaacgggttccccggggtaaaaccccgggtaacgggaacccggggtttaaaggggtacgggtaaacccggttaaacgttaacccggggtaaaaaccggttttaccgggnggggtttacccggaccgttacccgggacccttaaacccgtttcggttacgtttacccgttacggttaaccttcccgtttaaaccccgg

SEQ ID NO: 176373 - DNA, 823 bp, Homo sapiens
  misc_feature: GYAE6OF01DXB3A.17.43.D10.1.454.CMB.1.raw
  modified_base (196)..(196): a, c, t, g, unknown or other
  misc_feature (196)..(196): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctacgaggggaacngcccacctctcctgcgagggccagtcagagtgtgagcagctaacttacgccgtggtatcgagacgaacgaaccgtcggacccacggcctacccgaggtcctcctcgtatctagtcggtactccgttccgaccgacgggtccgtcgtcggtccgtacccgagaccgtagacgttacggacggggacgtagggtcgggtacgtacggggtaacaacggttacgttccaccgttctaccgtaaccgtacgtaccgacggacctaccgtcccggtaggtaccgtacggttaccgtaagggttaaacggtttacgttttacggtacgtttaacggtttttaacttaccgttagttaacctgtaaccttaaaccgtttaacggttaaaaccgttaacccgggggtaccccggggggtaaccccccgggggggttaccggttaacccgggggtaaccggtaaacccgggggtaccggtaaagggggttacgggtaaacgggtaaccgttaaaacccggaaaccggtttaaaccgggtagggtaccgggttaccggttaaccgtacccgtaacccgttaccggttttacccgttacccggttttacccgttcccgttacccgtttaaccccccgg

SEQ ID NO: 176374 - DNA, 773 bp, Homo sapiens
  misc_feature: GYAE6OF01B57DP.17.43.D10.1.454.CMB.1.raw
  modified_base (187)..(187): a, c, t, g, unknown or other
  misc_feature (187)..(187): n is a, c, g, or t
  modified_base (543)..(543): a, c, t, g, unknown or other
  misc_feature (543)..(543): n is a, c, g, or t
  modified_base (658)..(658): a, c, t, g, unknown or other
  misc_feature (658)..(658): n is a, c, g, or t
tcagcgtagactagcacgaccggtgctcgatttagactagcagtaagggggggaggaactgcgtcaggttaggacccagacggaaccatggaagccccagcgcagcttctcttcctcctgctactctggctccagatactactggagaaatggtgatgacgcagtctccagccacctgtctgtttcncgagggacacgccacctctcctgccgacgggtccagtccgagtacgtgtagacgacgacgactaaacgttcggtaccgttaggtaactacgacgtaccgaaacggtaaacccgtcggaacccgtaacggtccctacccggaacggtccttacccctacgattcgttacggttcgggtctacccgttacccgaaccggtcgggcccgtcggtttcgggaccgtacccgacggacctaggtacttcgggacggtgtacggttcgggtcgacgggtacgagtacgtccacgtcgtaccacgagtcgagtaccgacgtcctgtaccgtgttacagtagttctttagcctttaagtttacncgtacgtacgtaacgttaacgtaagtaacgttaaccgtaccgggggttccccgggggtaacccgggggttacgttacccggggtaaaccgacgggggtaacgtaaccgggggtanaaacggtaacccgtaacggtaaaccgggttggtacccgggttaggacccgtcgtaaaaccccgttcgtaccgtttacccggtacttaccgttttaacccgcgtttaaccccccgg

SEQ ID NO: 176375 - DNA, 976 bp, Homo sapiens
  misc_feature: GYAE6OF01AIPUH.17.43.D10.1.454.CMB.1.raw
  modified_base (204)..(204): a, c, t, g, unknown or other
  misc_feature (204)..(204): n is a, c, g, or t
  modified_base (965)..(965): a, c, t, g, unknown or other
  misc_feature (965)..(965): n is a, c, g, or t
tcagcgtagactagcacgaccggtgctcgatttagactagcagtaaggggaggaactgctcagttaggacccagacggaaccatggaacgccccagcgcagtcttctcttcctcctgctactctggctcccagatactactggagaatggtgactggacgcagtcctcacgcctacccttgtcttcgttctaccggagggaacncgcctaccctctccgtagccgaacgggccctagtccgaggtagtgtacggacgacgacggtaaccgttaactcgggtacctaggttaacgaccgtacggaaccgaaaaccgggttaaacccgtcggggtaacccgcggggtaaacccctttccccgggaagggtaccccttcccggtactaaccgtttaacccgtacgggttttccgggtaaacctttcccccggttacccgaaacccgggtaccggggttacccgtcgggtttaacgggtcccttaaccccgggaacggttacccgaaaacggtttccgggttaccggggaggggttacccccgggttaaggggttcccgggggtttaccggaaggggttaaccccgtaagggttaccccgttacgggtaaccttttaccccgaaccctaacggtaacgtacccgggaacggtccgtaaccggtcccggtacggttacccgtaacggggttccttaaacgggttaacgtttacgtttaccggtaacgtttttaacgtttaacgttaccgtttaacgggtaccttaaccgtaaccgttaacgttaaacccgtttaacgggtaaccccggggttaacccgggggtaccccgggggttaaccggttacccggggtaaacggtaaccccggggtaccgggtaaacgggtaaccggtaccggtaaaccgtaaccgtaaccggtacgttaacgggcgacgttaccgacgtacgtacgttaccgttaacgtccgttntacggttaccc

SEQ ID NO: 176376 - DNA, 968 bp, Homo sapiens
  misc_feature: GYAE6OF01DJ27M.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggcctccagatactactaggagaaatggtgactagacgcagtctcacgccacctgtcttgtttccaccggaaggggacacgccctaccctctccgtagccgacgggccaggtaccaaggtgtggtagacgacgagacctaacgttcgacgttgtacgtacacgacgaacggaaaccgtcggaccgacgtacctccgacggtctacctcgtactcgtacgtggtctccgtaccaccggcggctcgtcggtaccaccgacgtcgaagtcgtacggaggcgtagggtcggtacggtagggactacggttaacgtcgtaccgttcctaaccgtactagaaccgtaccgacgtaaccgggtccgttaaccggcgttaaaccgttacggttaaacgggttaacgttttaggtttttaacggtaaccgtttttaacggttttaaccgttttacgtacggggtttaacccttaaacgggttaaacccttttaggtttaaaaaacccggttaacccgggggtttaaccccgggggggtttaaccccccccgggggggggtacccccgggggggtttttttaaaacgggaccccccggggtttaaaaccgggggggaaaaccgggttttaacccggggggaaaccgggttttaaacgggggaaaccccggggttaaaaacgtaaccccggggtttaaaaaacccggggtttaccgggttaaacgggttccccgggggtttaacgaaaaccccggggttccccgttaaaaacccggtttccgtttaaaccccgggttttcccggttttaaccccgttttaacccccgggttcccgttttttaaacccccccggg

SEQ ID NO: 176377 - DNA, 814 bp, Homo sapiens
  misc_feature: GYAE6OF01EIT8T.17.43.D10.1.454.CMB.1.raw
  modified_base (195)..(195): a, c, t, g, unknown or other
  misc_feature (195)..(195): n is a, c, g, or t
  modified_base (791)..(791): a, c, t, g, unknown or other
  misc_feature (791)..(791): n is a, c, g, or t
  modified_base (802)..(802): a, c, t, g, unknown or other
  misc_feature (802)..(802): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtcctccacgccctacccgttgttcttgttttccnccggaaggggaaccgtacgccctaccccttctccgtacggcgacgggtccaggttccgaggtagtggtgaacgccacgtactaaacgttcggccttaggtactcgaacgacgaaacggtaaacccgtcgggaaccctacggtaccctcccgtacggtcccttacccgtactaacttcgttacggtccggttaccgtcccgttacccggaaccgggtccggggtcccgttccggttacggttcccggtacccaacggccctaagggtccgttaccgggaggggttccgtaggggttccgggtaggtacgggtacgtaacgttccggttactaccgtccttaaccaccgtactacgtaacgcgtaaccggtccgtagtacgtacgttcggtaaggttaacgtttacgtttacgtacgtttttaacggtttaaacttcggttaccgtaacgtactaacgttaagtaaaacgttcccgggtaacccggggtccccggggggtacccgggtacgttaccgggaaacggtaccgggtaacgtaagggtcggtaacgtacgtaaacgtaacggtcgtacggtgccgactccgtacttccgttntcggttacctntcccggttcccg

SEQ ID NO: 176378 - DNA, 854 bp, Homo sapiens
  misc_feature: GYAE6OF01BA73T.17.43.D10.1.454.CMB.1.raw
  modified_base (143)..(143): a, c, t, g, unknown or other
  misc_feature (143)..(143): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (772)..(772): a, c, t, g, unknown or other
  misc_feature (772)..(772): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactgganaaatggtgatgacgcagtctccagccacctgtctgtttccncgaggggtacgngccctaccctctccgtgcgagggccagtcaggtagtgtgacgcacggactaaccgtttaggcccttaggtactccgaaggtaccaaacggtaaacccgtcgggacccgaacgggcccttacccccgagggtcccttaccccttacgaaccttaccgtaggttcggggtttccgtccctttaaccccggcccggtaagggggtccccggtacgttttacggggtcccgttacccccgaggaccccgtaacgggtacctttaccggggaaggggggtaccttaggggttcgggggttaccggtacgggggaaaacctaggggttaacggtttacccacccgttttacgtaaccccgaaacccgtacgttacccgaaggcccgtaacgggtcccccgttaggaacccgtacgggtttacttaaacgggtaaagtttaccgttttcggaacgttttaggttttactttaaccgtcggttacctacggtaactaaccgttaaactaaccggttaccggggtcccggggggtaccccgggggttactccgggaaccggaacgggtacgtagggtacggtaanaccggttaaaccgaagggtaccgttgggcggtccctagacccttacccgtacggttcttacgtcctttccgccgttaccccg

SEQ ID NO: 176379 - DNA, 940 bp, Homo sapiens
  misc_feature: GYAE6OF01DZLGO.17.43.D10.1.454.CMB.1.raw
tcagcgtagactagcacgaccggtgctcgatttagactagcagtaaggggaggaactgctcagttaggacccagacggaaccatggaacgccccagcgcagcttctccttcctcctgctactctggctcccagatactacgtggagaatggtgatgacgcacgtcctccagccctacccttcgtctttcgtttccgtacccggtaaggggaaccgcgaccccacccttcctcctgaccggacgggacctagtcgaggtagtgtagacgacacgtacctaaccttacggccgttaggtacctcgaacggaccgtaaaccggtaacccggtcggaccggtacggtcccctaccccggtacggtcccttaccccgttacgtaacgtttccggtttaacggttccgggtttaccgttacccccgtttacccgggaacccgggtaccggggtccccgtcgggtttacggtaccccgtccccgtacgacgtacggttccgtacggggtacgggtccgttaggggtcgggtaccggtagggaaccgttacgggttacgttacgtaccggtacctaccccgaaccgtagtacccgtaccgacgtaccggtacctaccgtacggtaccggtttacgtaaggttacgttttacggttttaccggtagtttttaacggttttaaccgtcgtttagtacccggaatttacccgttaaacggttaacttaaaccccgggggtttacccgggggaccccgggggggtttaacccccgggggtacgggttaaaccccggtaccgggggtaaaccgggtacgggtaacgggtaaccgggaacgttaacccggttaaaccgggtaaaggttacccgggtgtacggttcccggtaacctcccggtaaccgttccgtttacggttacccctttaccgtttccctacccggtttaccccg

SEQ ID NO: 176380 - DNA, 506 bp, Homo sapiens
  misc_feature: GYAE6OF02IC5TQ.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgctagtttattactgtcagcactataataactcgggccccgggggattccgggccaacgggaccaaggtggagatacgaacggaactgtggctgcaccatctgtcttcattcccg

SEQ ID NO: 176381 - DNA, 536 bp, Homo sapiens
  misc_feature: GYAE6OF02G41EJ.17.43.D10.1.454.CMB.1.raw
  modified_base (312)..(312): a, c, t, g, unknown or other
  misc_feature (312)..(312): n is a, c, g, or t
tcagcgtagactagcacgaccggtgctcgatttagactagcagtaaggggggaggaactgctcagttaggacccaggacggaaccatggaagccccagcgcagcttctcttcctcctgcctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccnctggtcgtcccagccagattcgaggggcaggtgggtctgggacagagttcactctcaccatcagcagcctgcagtctgaagtattttgctagtttattacttgtcagctactataataacgtcgggaccccggggggtacgttccgggaccgtaacgggaccgaaagggtggagagtacgaaacggaacgtaggtggctgacaccagtctgtcttctattcccg

SEQ ID NO: 176382 - DNA, 523 bp, Homo sapiens
  misc_feature: GYAE6OF02IEW1M.17.43.D10.1.454.CMB.1.raw
  modified_base (305)..(305): a, c, t, g, unknown or other
  misc_feature (305)..(305): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctccaggctcctcatctatggtgcttccacaggccnctggtgtcccagccagattcaggggcagtgggtctgggacagagttcactctcaccatcagcagcctgcagtctagaagtattttgctagtttattactgtcagcactataataacgtcgggccccggggggtagttccgggaccaacggggaccaagggtaggagacgtacgaaacggaacgtggtacggctgacaccattcctgtcttcattcccg

SEQ ID NO: 176383 - DNA, 505 bp, Homo sapiens
  misc_feature: GYAE6OF02I2XP0.17.43.D10.1.454.CMB.1.raw
  modified_base (388)..(388): a, c, t, g, unknown or other
  misc_feature (388)..(388): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcagggcagtgggtctgggacagagttcactctcaccatcagcagcctgcagtctgaagtnttttgctagtttattactgtcagtcactataatactgggccccgggggagttcggaccgaagggaccaagggtgagagtacgaacgactgtggctgacacagtctgtcttcattccg

SEQ ID NO: 176384 - DNA, 525 bp, Homo sapiens
  misc_feature: GYAE6OF02GIDZM.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtatgtttctccaggggaacgagcccaccctctcctgcagggccagtcagagtgtgagcagcaacttagcctggtatcagcagaaacctggccaggctcccaggctcctcatctatggtgcttccaccgagggccgctggtcgtcccagccagattcgaggggcaggtgggtctgggacaggagttcactctcaccatcagcagcctgcagtctgaagtatttgctagtttattactgtcagctactataatacgtcgggccccggggggtagttcggaccgaacgggaccgaagggtggagagtacgaaacgtaacgtgtcggctgacactatcgtgtcttcattcccg

SEQ ID NO: 176385 - DNA, 623 bp, Homo sapiens
  misc_feature: GYAE6OF02JN7I3.17.43.D10.1.454.CMB.1.raw
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
tcagcgtagactagcacgaccggtgctcgatttagactagcagtaaggggagggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttgcctggtatcagcagaacctggccaggctcccaggctcctcatcctatggtgccttccaccagggcccgctggtacgtcccagccagattcgagggtcaggtgggtcgtgggacagagttcactcgtcacctntccagcagcctgcagtctagaacgtatttgacgtatttacgttactgtcaagtctaagttaanaaacgtttaaccgtcggggtacccccgggggggtaacgtttccggacccgtaaacggggtaccgaaacggggttacggaagggtacgtaccggtaaaaccggtaaccggtaacggttcgggtaccgttacggacccgtaaccgtacggttaccgttacggttacccgtttacgtaactttccccgg

SEQ ID NO: 176386 - DNA, 525 bp, Homo sapiens
  misc_feature: GYAE6OF02F6VQF.17.43.D10.1.454.CMB.1.raw
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcagggcaggtgggtctgggacagagttcactctcaccatcagcagcctgcagtctgaagtattttgctagtttattacttgtcagtcacttataataacgtcgggaccccggggggtacgttcggaccgaacgggaccgaagggtggagagtacgaaacgaactagtggctgacacgatctgtcttatcttacccg

SEQ ID NO: 176387 - DNA, 510 bp, Homo sapiens
  misc_feature: GYAE6OF02IMLNW.17.43.D10.1.454.CMB.1.raw
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccgagggccgctggtcgtcccagccagattcgagggcagtgggtctgggacagagttcactctcaccatcagcagcctgcagtctgatatttgctagtttattactgtcagcactataatacgtcgggaccccgggggtacgttcggaccgaacgggacgaagggtgagatacaaacgactgtggctagacacatctgtcttcattccg

SEQ ID NO: 176388 - DNA, 503 bp, Homo sapiens
  misc_feature: GYAE6OF02IFK4M.17.43.D10.1.454.CMB.1.raw
  modified_base (305)..(305): a, c, t, g, unknown or other
  misc_feature (305)..(305): n is a, c, g, or t
tcagcgtagactagcacgaccggtgctcgatttagactagcagtaagggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttcaccagggccnctggtgtcccagccagattcagggcagtgggtctgggacagagttcactctcaccatcagcagcctgcagtctgaagattttgctagtttattactgtcagctactataatacgtggccccgggggagttcggaccaagggaccaagggtgagagtacgaacggactgtggcgtgcacatctgtcttctatttccccg

SEQ ID NO: 176389 - DNA, 517 bp, Homo sapiens
  misc_feature: GYAE6OF02HF0DS.17.43.D10.1.454.CMB.1.raw
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctcatctatggtgccttccaccgagggccgctggtcgtcccagccagattcgaggggcaggtgggtctgggacagtagttcactctcaccatcagcagcctgcagtctagaagtatttgctagtttattactgtcagtcactataactaacgtcgggccccgggggtacgttcgggaccgaacgggaccgaagggtgagatacgaacgactgtggctgacacatctgtcttcattcc

SEQ ID NO: 176390 - DNA, 539 bp, Homo sapiens
  misc_feature: GYAE6OF02IA5S4.17.43.D10.1.454.CMB.1.raw
  modified_base (203)..(203): a, c, t, g, unknown or other
  misc_feature (203)..(203): n is a, c, g, or t
  modified_base (378)..(378): a, c, t, g, unknown or other
  misc_feature (378)..(378): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccaggggacagccaccctntcctgcagggccagtcagagtgtgagcagcaacttagcctggtatcagcagaaacctggccaggctcccaggctcctcatctatggtgcttccaccagggccgctggtgtcccagccagattcgagggcagtgggtctgggacagagttcactctcacatcagcagcctgcagtntgaatatttgctagtttattactgtcagcactataaataacgtcggaccccggggggacgttccgggaccgaaggggaccaaagggtcggagacgttacgaaacggtaacgtcggtaggaccttgacctaccgacgtcttaggtcctttaccgattccccg

SEQ ID NO: 176391 - DNA, 827 bp, Homo sapiens
  misc_feature: GYAE6OF02JLY8S.17.43.D10.1.454.CMB.1.raw
tcagcgtagactagcacgaccggtgctcgatttagactagcagtaaggggagggaacgtgctcagttaggacccagacggaaccatggaagcccagcgcagcttctcttcctcctgctactctggctcccagatactactggagaaatggtgatgacgcagtctccagccaccctgtctgtttctaccgaggggacacgccaccctctcctgcagggccagtccagacgtgtgagcagccaacttgcctggtactcagcacgaaacctggaccaggctcccgaggcctcctacacttccgtatcggtcgtccttcccgaccgacgggccccgtcgtcggggtccttccccacggccccgtaggtaactttccggaacggggtccgtacgggttcggggtccgtacgggggtaccaggtacgtttccgaaccttcgtacccaaccgtaagttccgacgggtaccaacggtcccttaggcccgtaagttccgtacggtaaagttcgtttttacgaccgtttaaggttttaactttacgttacggtaccgtaggttacccaaccgtttaaacttaaaacggtttaaccccggttccgggggggttacccccccggggggggttaacgttttaccccggggaacccgtaaaaccggggggttaacccgtaaaccgggggttgaaaaccggggtacgtttaaaccccggaaaccggtttaaaccggtccgggttttaaccgggggccgttaaccccgggttacaaacccccgggtttctacccggggtttaaccggtttaccttttaccggtaacccggttttaaccccggg

SEQ ID NO: 176392 - DNA, 530 bp, Homo sapiens
  misc_feature: GYAE6OF02H7DCW.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagcccaccctgtctgtttctccaggggaacagccaccctctcctgcagggccagtcagagtgtgagcagcaacttagcctggtatcagcagaaacctggccaggctcccaggctcctcatctatggtgcttccaccagggccgcttgggtgtcccagccagacttcgagggcagtgggctgggacagagttcactctcaccatcagtcagcctgcagtctagaagtatttgactagtttattactgtcagcaactataaactacgtcggaccccggggggtacgttccggacgaacgggacaagggtcggagacgtacgaacggacgtggtaggactgacactagtcctgtaccttcattcccg

SEQ ID NO: 176393 - DNA, 540 bp, Homo sapiens
  misc_feature: GYAE6OF02GPTDL.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaaacttagcctggtatcagcagaaacctggccaggctcccaggctcctcatctatggtgcttcccaccaggggccgctgggtgtccccagcccagattcaggggcaggtgggtctggggacagagttcactctcaccatcagcagcctgcagtctgaagtattttgctagtttattacttgtactagcaactattaaataactcgggtaccccggggggtacgttccgggccgaaagggaccgaagggtaggagagtacgaaacgaacgtagtaggctgactacgatctgtcttcattcccg

SEQ ID NO: 176394 - DNA, 563 bp, Homo sapiens
  misc_feature: GYAE6OF02GEC9S.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctgggtgtccccagccagattcgagggcagtgggtctggggacagagttcactctcaccatcagcagcctgcagtctgaagtattttgctagtttattactgttcagtcacttaattaaactaacgtcggggacccccgggggggtacgttccgggaccgtaaacgggtacccgaaagggtcgggagacgtacgaaacggtaactaggtacggcttcggaccaccgacgtaccgttgtccttacctagttcccg

SEQ ID NO: 176395 - DNA, 550 bp, Homo sapiens
  misc_feature: GYAE6OF02IHEHN.17.43.D10.1.454.CMB.1.raw
  modified_base (307)..(307): a, c, t, g, unknown or other
  misc_feature (307)..(307): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagataatactggagaaatggtgatgacgcagtctccagccaccctgtctgtttctccaggggacagccaccctctcctgcagggccagtcagagtgtgagcagcaacttagcctggtatcagcagaacctggccaggctccaggctcctcatctatggtgccttccaccgagggccngtggtcgtcccagccagtattcgagggcaggtgggtctgggacagagttcactctcaccatcagcacgctgcagtctagagtattttgctagtttacttatgtacagactactataacgtaacgtcgggaccccggggggtacgttccgggaccgaacgggacgaagggtaggagtacgtacgaaacgtaacgtaggtacggacgtcgaccgacgtagtaccgttagtccttactacttcccg

SEQ ID NO: 176396 - DNA, 634 bp, Homo sapiens
  misc_feature: GYAE6OF02G2UEO.17.43.D10.1.454.CMB.1.raw
  modified_base (371)..(371): a, c, t, g, unknown or other
  misc_feature (371)..(371): n is a, c, g, or t
  modified_base (436)..(436): a, c, t, g, unknown or other
  misc_feature (436)..(436): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcaagaaacctggaccaggcctcccgaggcctccctcacttctagtggtctccttcccgaccgacggggccgcgtgggtcgtcccagccagtacgttcggagggctaggtgggtcgnggggacaggtacgttcacttcctaccacctatacgagccacgtccgtgcctagtctagtaagttntttcgacttagtttactacgtgtacagtacctaattaagtaacgtaccgggtcccgggggtaccccgggggtacgttccgggaaccgtaacggggtaccgaaggggtaggaacgtacgtaaccgaaacggtcgtacgggtacggtacgtacgaccgtaccgttacgttccgttacgtttccttacgtaccgttccccg

SEQ ID NO: 176397 - DNA, 605 bp, Homo sapiens
  misc_feature: GYAE6OF02IWPUQ.17.43.D10.1.454.CMB.1.raw
  modified_base (185)..(185): a, c, t, g, unknown or other
  misc_feature (185)..(185): n is a, c, g, or t
  modified_base (429)..(429): a, c, t, g, unknown or other
  misc_feature (429)..(429): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggaacgagccaccctctcctgcagggccagtcagagtgtgagccagcaacttagcctggtatcagcagaacctggccaggctccaggctcctcatctatggtgccttccaccgaggccgctggtcgtcccagccagacttcgagggcaggtgggtctagggacaggtagttcaacgtcctcgacctatccagcgacgtccgtgcgtagtctagaagtatttcgctagtttacttacgtntcacgtactacgttaataaaccgttacgtccggggtaccccggggggtacgttaccgggaccgaacggtaacggaacggtagggaacgtacgtaacgaaaaccggtaacggtacggtagggtaccgtacggacctaaccgacgttaccgttgttaccgtttcctagtttaccccgg

SEQ ID NO: 176398 - DNA, 682 bp, Homo sapiens
  misc_feature: GYAE6OF02HHPWQ.17.43.D10.1.454.CMB.1.raw
  modified_base (290)..(290): a, c, t, g, unknown or other
  misc_feature (290)..(290): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccacctctcctgcagggccagtcagagtgtgagcagcaacttgcctggtatcagcaagaaacctggccaggcctcccagctctcatctanggtcgcttccaccgaggccgcgtggtcgtcccagccagacttcgagggctaggtgggtcgtagggacaggtagttcaaccgttctaccacctagtcgaacgtcacggcccttagccgtaacggttccgtaaggtaaacggttagtttttcggactttaggttttaacttacgtttcggttacctaagtacctaacgttaagttaaacgttaacccggttacccggggggtacccccgggggggttaacgtttacccgggaaccggtaaaccgggggtaaccgtaaggggttacgggaacgtacgttaaccgaaacgggtaacgttcgggtacggtaccgtacggaacctaccgtacgttccgttacggtttcccttacgtacctttccccgg

SEQ ID NO: 176399 - DNA, 594 bp, Homo sapiens
  misc_feature: GYAE6OF02HBQ4Q.17.43.D10.1.454.CMB.1.raw
  modified_base (311)..(311): a, c, t, g, unknown or other
  misc_feature (311)..(311): n is a, c, g, or t
  modified_base (396)..(396): a, c, t, g, unknown or other
  misc_feature (396)..(396): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggcctcccaggcctcctcatctatggtgccttccaccgagggccnctgggtctcccagccagacttcgagggcaggtgggtctgggacagtagttcactctcacatcagcagcctgcagtctagaagttntttgacttagtttattacgtgtacagtactacttaataacgttaaccggtcccgggggtaccccgggggggttacttaccggggaccgtaaacggggtaccgtaaggggtcggaacgtacgtaaccgaaacggtaacgtggtacggtcgttacggacctaaccgtacgttacgtacgtttccttacgacgtttccccg

SEQ ID NO: 176400 - DNA, 545 bp, Homo sapiens
  misc_feature: GYAE6OF02H4DIX.17.43.D10.1.454.CMB.1.raw
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgggcagcaacttgcctggtatcagcagaaacctggccaggctcccaggctcctcatctatggtgcttccaccgagggccntgggtctcccagccagattcgagggggcaggtgggtctggggacaggtacgttcactctcaccatcagcagcctgcagtctgaagtntttgntagtttattactgtcagcactaataactaacgtcgggccccgggggtacgttcgggaccgtaagggaccgaaaggtcggagagtaccgaaacggtacgtggtacggctgtaccacctacgtctgttctctacgtcttaccccg

SEQ ID NO: 176401 - DNA, 542 bp, Homo sapiens
  misc_feature: GYAE6OF02F6ZLA.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgcgtggtcgtcccagccagattcgacggggcaggtgggtctggggacaggagttcactctcaccatcagcagcctgcagtctgaagtattttgctagtttattacttgtcagcactataactacgtcgggtccccgggggtagttccggacgaacgggaccgtaagggtcggagacgtacgaaacggactaggtcggtacgtcgacgacacgtacctcgttcttctacttcccg

SEQ ID NO: 176402 - DNA, 582 bp, Homo sapiens
  misc_feature: GYAE6OF02HCNMT.17.43.D10.1.454.CMB.1.raw
  modified_base (311)..(311): a, c, t, g, unknown or other
  misc_feature (311)..(311): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgccttccaccagggccncgtggtcgtcccagccagattcgagggcaggtgggtctggggacagacgttcactctcaccatcagcagcctgcagtctgaagtattttgctagtttattacgttgtacagtctacgtaataaacgtaaccgtcggggtacccccgggggggtacgtttccgggaccgtaaacgggggacccaaagggtcgggaacgagtaccgaaacggaacttggtacggtcgttacggaccaaccgtactccgttacggtactttacctactttcccg

SEQ ID NO: 176403 - DNA, 565 bp, Homo sapiens
  misc_feature: GYAE6OF02I9N01.17.43.D10.1.454.CMB.1.raw
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacgagccaccctctcctgcagggccagtcagagtgtgagcagcaacttagcctggtatcagcagaaacctggccaggctcccaggctcctcatctatggtcgcttcccaccgagggcccgctgggtcgtccccagcccagacttcgaggggcagtggggtctggggacaggagttcacttctcaccatcagcagcctgcagtcngaagtatttgntagtttatactgtcagcactataactaacgcggggtccccgggggtacgttccggacgtaacgggaccgtaagggtaggacgataccgaaacggtacgttacggtagggtcctaggacccgaacctacgttaccgttcgtcctttacgctttaccccg

SEQ ID NO: 176404 - DNA, 541 bp, Homo sapiens
  misc_feature: GYAE6OF02ID112.17.43.D10.1.454.CMB.1.raw
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccagggaacagccaccctctcctgcagggccagtcagagtgtgagcagcaacttagcctggtatcagcagaaacctggccaggctcccaggctcctcatctatggtncttccaccagggccnctggtcgtcccagccagacttcgagggcagtgggctgggacagagttcactctcaccatcagcagcctgcagtctagaagtattttgctagttttattactgtcagctaatataagtaacgtcgggaccccggggggtattccgggaccgtaacgggaccgaagggtaggagacgtacgaaacggtacgtaggtacggacctagacgacctatccgtacggttcttcgattcccg

SEQ ID NO: 176405 - DNA, 541 bp, Homo sapiens
  misc_feature: GYAE6OF02F5ZEJ.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctcatctatggtgccttccaccagggccgctggtcgtcccagccagattcgaggggcaggtgggtctggggacaggagttcactctcaccatcagcagcctgcagtctagaagtattttgcttagtttattacttgtcagtctacttaataataacgtcgggacccccggggggtacgttccgggaccgaagggaccaagggtaggagtacgtacgaaacgtaacgtgtacggctgacaccagtcctgtcttcattcccg

SEQ ID NO: 176406 - DNA, 568 bp, Homo sapiens
  misc_feature: GYAE6OF02F8DK9.17.43.D10.1.454.CMB.1.raw
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (402)..(402): a, c, t, g, unknown or other
  misc_feature (402)..(402): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtnccttccaccgagggccncgtggtcgtccccagcccaggtattcgaggggcaggttgggtctggggacaggtagttcactctcaccatcagcagcctgcagtctgaagtntttcgcttagtttattactgtcagctaactaataataccgtcggggaccccgggggtagttccgggaccgtaaggggacctaaagggtcggaacgtacgtaaccgtaaacggaacgttaggtacgggctaggaccacgtacgtccgttcgtcttacactttccccg

SEQ ID NO: 176407 - DNA, 556 bp, Homo sapiens
  misc_feature: GYAE6OF02I27DQ.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgccttccacctagggccgcgtggtcgtcccagccagattcgagggtccaggtgggtctgggacaggtacgttcactcgtacaccgatacgagcagcctgacagtctagagtacttttgactagtttattacttgtctagctactataactaacgtcgggaccccggggggtacgttcgggacgaacgggtaccaagggtggagacgtaacgaacgaacgttggtggtacgtcgacgacctagtccgtagtcttacgattacccg

SEQ ID NO: 176408 - DNA, 629 bp, Homo sapiens
  misc_feature: GYAE6OF02J0B21.17.43.D10.1.454.CMB.1.raw
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaaacttgcctggtatcagcagaacctggccaggctcccaggctcctcatctagtggtcgccttccaccgtagggccgtctggtcgtccccagtccagtattccgaaggggtccagggttcggggtctaggggacaggtacgtttcgaacttcgtacaccctagtccaagccacgcctgcgtacgtcgtagtaagtagttttcgacttagtttattacgttgtcagtactacgttaattaacgtaccgttcgggtaccccgggggtattccgggaccgtaaacgggaccgtaagggttacgaacggtactaccggtaaacggtaacggttacggtacggtaccgttacggaccgaaccgttacgtccgttacggttacccttacgtaccgttcccg

SEQ ID NO: 176409 - DNA, 629 bp, Homo sapiens
  misc_feature: GYAE6OF02JL32F.17.43.D10.1.454.CMB.1.raw
  modified_base (185)..(185): a, c, t, g, unknown or other
  misc_feature (185)..(185): n is a, c, g, or t
  modified_base (277)..(277): a, c, t, g, unknown or other
  misc_feature (277)..(277): n is a, c, g, or t
  modified_base (510)..(510): a, c, t, g, unknown or other
  misc_feature (510)..(510): n is a, c, g, or t
  modified_base (582)..(582): a, c, t, g, unknown or other
  misc_feature (582)..(582): n is a, c, g, or t
  modified_base (605)..(605): a, c, t, g, unknown or other
  misc_feature (605)..(605): n is a, c, g, or t
tcagcgtagactagcacgaccggtgctcgatttagactagcagtaaggggaggaacgtgctcagttaggacccagacggaaccatggaagcccagcgcagcttctcttcctcctgctactctggctcccagatactactggagaaatggtgatgacgcagtctccagccaccctgtctgtttacnccaggggacagcccacctctcctgcagggccaggtcagagtgtgagcagcaacttagcctggtatcagcagaacctggccaggctccaggcncctcatctatcggtgccttccgaaccgtgggcccgtcgtcgggttcgtccccgaagccccgaggtactttccggaagggggtccaaggtttcggggaccttgggggaacctagggtaagtttcccaacgtttcccgtacgacccctaagttcccgaagggccctaagtcccctaggccctaggttcctaggaacgttactttttggaccgtaggtttttacttacgttcggtnacgtcaacgttataaacgtacgtggggtaccccccgggggattcggtaccacgggtaacacgggtgacgtancgtaacgacgtgtcggctgtacncgtatccgtagtccttcagttccc

SEQ ID NO: 176410 - DNA, 592 bp, Homo sapiens
  misc_feature: GYAE6OF02HEOF5.17.43.D10.1.454.CMB.1.raw
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccacggcctcccgacggcctcctcactctatggtgccttccaccgacgggcgtgcgtcggtcgtcccgacgccagtattcgaggggcgaggtcgggtcgtgggacgaggtacgttcgactcgggggtaccaccactcacgcgacgccgtcgcgagtcgtagtaagtagtttgtacgttagttttattacttgtctagtctacttaattaactaacgtccggggaccccgggggtaccggttccggaccggaacgggaaccgaacgggtaggacgtacgtacgaaacgaacgtagtacggtacgtcgacacgtactcgtcgtcttctacg

SEQ ID NO: 176411 - DNA, 714 bp, Homo sapiens
  misc_feature: GYAE6OF02GC85P.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttagcctggtatcagcagaaacctggacccaggcctacccgaggtcctccctacgactcttagtgggtcgcctttacccgaccgacgggcccgcgttcgggtcgtaccccaggcccagtacttcggagggtcaggtgggtcgtacgggacaggtacgttccaacttcctaacgaccctatcgacgccacgtccgtagccaggttcgtacgtaaaggttattttcgacgtttaaggttttactttaccgttgttacgtaacgtaccttaacttaaacgttaaacgtaaccgggttcccgggggtaccccccgggggggtagtttacccggggaccgggtaaacccggggtaaccggtaaacggggtacgggaacggtacgtaaaccggtaaaaccgggtaaccgttaggtaccggtaccgttacggaccttaaccgtagttccgttacgtttcccttacgtaccgtttacccccgg

SEQ ID NO: 176412 - DNA, 517 bp, Homo sapiens
  misc_feature: GYAE6OF02ICHB8.17.43.D10.1.454.CMB.1.raw
  modified_base (312)..(312): a, c, t, g, unknown or other
  misc_feature (312)..(312): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcaagaaacctggccaggcctcccaggctcctcatctatggtgcttccacgacgggccnctcgggtcgtcccagccagtacttcgaggggcaggtgggtctgggacagagttcactctcacatcagcagcctgcagtctagaagtatttgctagtttattactgtcagcatataataacgtcgggacccgggggtatcggacgaaggacgaaggtggagagtacgaacgtacgtggtggcgtgcacatctgtcttccattcccg

SEQ ID NO: 176413 - DNA, 629 bp, Homo sapiens
  misc_feature: GYAE6OF02GHDFA.17.43.D10.1.454.CMB.1.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggacagccaccctctcctgcagggccagtcagagtgtgagcagcaacttagcctggtatcagcaagaacctggccaggcctcccgaggtcctcctnatctagtggtcnccttccaccgagggccncgtggtcgtcccagccagtacttcggaggggcagggttcgggtcgtaggggacaggtacgtttccacgttcctaccaaccgtatcgagcacgcctgctagtctagtaagttattttcggacttaagttttacttacgttgtactagtactaacttaataaacgtaacggttccggggaccccggggggttacgttaccgggaccgtaacgggaaccggtaagggtacggacgtacgtaaccgaaacggtacgtacggtacggtacgtacggacctaccgtacgttccgttcgttaccgttactacgttccccg

SEQ ID NO: 176414 - DNA, 758 bp, Homo sapiens
  misc_feature: GYAE6OF02IYULP.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttgcctggtatcagcaagaaacctggccaggcctcccgaggcctcctcactctagtggtcgtccttcccaccgacggggcccgcgttcgggtcgttccccgacggcccgaaggtacgttccggaagggggcctaagggttcgggggtcgtagggggaactagggtaacggtttccaaccgttcctaccgaaccctaacttccgaacgaccgtaacggtccccgttggaccgtaacggttcccgttagggtaaacggttactttttaggaccgttaaggttttaactttacgttcgttactacgtacctaacttaacgtaaacgttaaccggtcccgggggtacccccggggggggttaacgtttacccgggggaccgtaaaccgggggtaacccgtaaacgggggtacgggtaacgtaacgttacccggaaaaccggttaacgtacgggtacgggtaccgttacggacccgtaaccgtacgttaccgttacggtttaccctttaccgtacttaccccgg

SEQ ID NO: 176415 - DNA, 632 bp, Homo sapiens
  misc_feature: GYAE6OF02IST0M.17.43.D10.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (397)..(397): a, c, t, g, unknown or other
  misc_feature (397)..(397): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggctcctcatctagtggtnccttccaccgagggccnctggtctccagccagtatcgagggcaggtgggtctgggacagtacgttcactctcaccatcagcacgcctgcagtctagaagttntttcgacttaggtttattacgtgtactagtactaacttattaaacgttaccggtccgggggtacccccgggggggtacgtttaccggggacccggtaaacggggacccgtaaaggggtcgggtaacggacgttaaccggtaaaaccgggtaacgttacgggtacgggtaccgttacgggaccctaaccgttagtttacccgttacggtttaccgtttaccgaccgtttcccccgg

SEQ ID NO: 176416 - DNA, 714 bp, Homo sapiens
  misc_feature: GYAE6OF02JR5IB.17.43.D10.1.454.CMB.1.raw
  modified_base (197)..(197): a, c, t, g, unknown or other
  misc_feature (197)..(197): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccacctgtctgtttctccgaggggaacngccaccctctccgtgcagggccagtcagagtgtgagcagtcaacgttgcctggtatcagcaagtaacctggccaggcctcccgaggtcctcctacactcctagtcggtcgtccttacccgaccgacggggtcctccgttgggtccgtccccagtccccgaaggtacttaccggaggggtcctagggttcgggtccgttagggggaaccagggtacgtttccgaaccgttccgtacccacccgtagtcccgaagccgacgtcccgtacgcgtaacgtcgtagaacgttagttttcgaccgttaggttttaacttccgttagtaccgtaacgtacctaacgtttaacttaaccgttaaccggtccggggtacccccggggggttaggttacccgggaccgtaaaccgggaaccggtaacgggttagggaacgtacgtaaccgaaaccgggtaaccgtacggttacggtaccgtacgaccgtaccgtacgtaccgttcgttacccttcgaccgtttcccg

SEQ ID NO: 176417 - DNA, 648 bp, Homo sapiens
  misc_feature: GYAE6OF02JOTJM.17.43.D10.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (636)..(636): a, c, t, g, unknown or other
  misc_feature (636)..(636): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttcnccgaggggacngccaccctctcctgcagggccagtcagngtgngancagctaacttgcctggtatcgagcaagaacctggaccaggcctcccaggcctcctcatctagtggtcgtccttccgaccgacgggtccgcgtcggtccgtcccgaggtacccaggtaacttcggagggtccaggttcgggtcgtagggacaggtacgttcaacgtcctacaaccgtgtcacggacacggtcctagcgtagtcgtanaacggttntttcgacttagtttactacgttacgtcgtaacgtctaaacgttaacgttaaacgtaacccggttaccggggggtacccccggggggttagtacccgggaccggtaaacgggaccgtaagggtaggacgtacgtaaccggaaacggtacgtacggtaggtccgtacgtacgaccttagtaccgtgttacccttntaccgttacccg

SEQ ID NO: 176418 - DNA, 567 bp, Homo sapiens
  misc_feature: GYAE6OF02HZOB5.17.43.D10.1.454.CMB.1.raw
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgcttctccaggggaacgagcccaccctctcctgcagggccagtcagagtgtgagcagcaacttagcctggtatcagcagaacctggccaggctcccaggctcctcatctatggtncttccaccagggccgctgggtcgtcccagccagattcgagggggcaggtgggtctggggacaggagttcactctcaccatcagcacgcctgcagtctaggaagtnttttgcttagtttatttacgttgttacagtctactataaattacggtaccggggtaccccgggggggtaccgttaccgggtaccggaaagggaccgtaaggggtcggagacgtacgaaacggtacgtggtacggcgtaggccaccgtattccgtgttcctacgtaccg

SEQ ID NO: 176419 - DNA, 729 bp, Homo sapiens
  misc_feature: GYAE6OF02HXFB6.17.43.D10.1.454.CMB.1.raw
  modified_base (143)..(143): a, c, t, g, unknown or other
  misc_feature (143)..(143): n is a, c, g, or t
  modified_base (210)..(210): a, c, t, g, unknown or other
  misc_feature (210)..(210): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactgganaaatggtgatgacgcagtctcagcccaccctgtctgtttcaccgaggggaacagcccaccctctccngacagggccagtcagagtgtgagctagcaacttagcctggtatcagcaagaaacctggcaggctcccaggcnctacatcctanggtcncttccacncggccgctggtcnccgagccaggattcgacgggcagtcgggtctagggacaggagttcgaactcgtacaccagtcagcgacgcgtcggactacgtacgtaggtaacgttaagttttcgacgttaacgtttaagttttaccgtggttaacacggtacctaaacgttaaacgttaaacgtttaaacccgggtccggggggtaaccccccgggggggggttaccgttaacccgggtaaacccggggtaaacccggggggtaaacccggtaaaaccggggttaacggggtaacgggttaaaacccgtaaccggttaaaaacccgggtaaacggttaaaccgggttcggggtaaccgtttaaccggacccgtaaccgtaacgttccgtttacggtttacccgttaccgttacccgtttaaccccccgg

SEQ ID NO: 176420 - DNA, 541 bp, Homo sapiens
  misc_feature: GYAE6OF02FQ8X9.17.43.D10.1.454.CMB.1.raw
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcagaaacctggccaggctcccaggctcctcatctatggtgccttccaccgagggccgctggttgtccccagcccagacttcgaggggtcaggtgggtctggggacaggngttcactctcaccatcagcagcctgcagtctgaagtntttgctagtttatactgtcagctactataataacgtcgggtccccggggggtagttccggaccgaagggaccaagggtcggaagatacgaaacgaacgtggtcggactcgaccaccgtatcgttcgtcttacattcccg

SEQ ID NO: 176421 - DNA, 579 bp, Homo sapiens
  misc_feature: GYAE6OF02F3I2M.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgcttccaccagggccgctgggtcgtccccagcccagattcgagggcaggtgggtcctggggacaggagttcactctcaccatcagcagcctgcagtctagagtattttgctagtttatacttgtcagtcaactataagttacgtcggggtacccccggggggtacgttccgggaccgtaacgggaccgaagggtcggaacggtacgtaccgaaacggtaacgtaggtacgggtaccgttcgacctaaccgtacttaccgttacggttacctttaccgactttccccg

SEQ ID NO: 176422 - DNA, 818 bp, Homo sapiens
  misc_feature: GYAE6OF02JBIVK.17.43.D10.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
tcagcgtagactagcacgaccggtgctcgatttagactagcagtaagggggggaggtaacggtgctcgagttaggacccagacggaaccatggaagccccagccgcagcttctcgttcctcctgctactctgctcccagatacctactgganaaatgggtgagtcgacgcagtcctccagcccaccgtgtcttcgtttccnccgaggggaacgacgcccaaccctctccgtgccagggccagtcagagtgtgagcagacaacgttacgccgttggtatcgaagcaagaacctggccgaaggcctcccaggcctcccgtnactactacgtccggtagccttaccgaaccgtagggccgtcgtcgggttccgtaccccgagccccaaggttacgttcggaacggggtctacgggttcgggggttacccgtacgggggacgtaacggtacggtttacccgaaccgttcccgtacccgaaacccgttaccgtttaccccgaacggacccgtaaccggtcccccgttaggaccccggttacggttacccggtaacggtaaacggtttacgttttacggaaccgtttaaacggttttttaaccgttacgttacggtttaccaacgttaccttaaacgttaacgttaaacgttaacccgggtcccggggggtaacccccggggggttcgttaacccgggaccggttaaacggggaacccggtaagggtacgtaacggtacgtaaccgtaaacgggtacgtagggaccgtaccgttaacgaccgttaccgagttcccggtatacccgtacgtaccgtttaccccgg

SEQ ID NO: 176423 - DNA, 542 bp, Homo sapiens
  misc_feature: GYAE6OF02FTUU9.17.43.D10.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (396)..(396): a, c, t, g, unknown or other
  misc_feature (396)..(396): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctctcctgcagggccagtcagagtgtgagcagcaacttagcctggtatcagcagaaacctggccaggctcccaggctcctcatctatggtnccttccaccagggccnctgggtcgtcccagccagacttcgaggggcaggtgggtctggggacagagttcactctcaccatcagcagcctgcagtctgaagtntttgctagtttattactgtcagtcaactattaacgtaacgtcggggacccccggggggtagttccgggaccgaagggaccgaagggtggagagtacgaaacgtacgtggtacggctagccaccgtatccgtgtccttcacttcccg

SEQ ID NO: 176424 - DNA, 602 bp, Homo sapiens
  misc_feature: GYAE6OF02GSMJT.17.43.D10.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccgaggcctcctcatctatggtnccttccaccgaggggccnctggtcgtcccagccagcttcggagggcaggtcgggtctggggacaggtacgttcactctcaccatcgagcacgcctgctagtctagaagtatttcgacttagtttacttacgtgtactagtactaactaataacgtaaccgtccggggtacccccggggggtacgttccgggaccgtaaacggggaccgtaaacggggtggaacggtacgtaacgtaaacggtaacgttacggtacggtacgtacgaccgtaaccgtacgttaccgttcgttacttacgtacttcccg

SEQ ID NO: 176425 - DNA, 618 bp, Homo sapiens
  misc_feature: GYAE6OF02G9XKI.17.43.D10.1.454.CMB.1.raw
  modified_base (312)..(312): a, c, t, g, unknown or other
  misc_feature (312)..(312): n is a, c, g, or t
  modified_base (402)..(402): a, c, t, g, unknown or other
  misc_feature (402)..(402): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggctcctcatctatggtgccttccaccgagggccncgtgggtcgtcccagcccagacttcgaggggcaggtgggtctgggacagagttcactctcaccatcagcacgcctgcagtctagtaagtnttttgcttagtttattacttgtcagtactattaataacgtaaccgtccgggggtacccccggggggtagtttacccgggaccggtaaacggggtaccgtaaaggggtacgggaaggtacgtaaccggaaaacggtaaccgttacgggtacgggtccgttacggaccctaacccgtacgttccgttacggttacccgtttacgtactttacccccgg

SEQ ID NO: 176426 - DNA, 621 bp, Homo sapiens
  misc_feature: GYAE6OF02FR26X.17.43.D10.1.454.CMB.1.raw
  modified_base (233)..(233): a, c, t, g, unknown or other
  misc_feature (233)..(233): n is a, c, g, or t
  modified_base (368)..(368): a, c, t, g, unknown or other
  misc_feature (368)..(368): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccacctgtctgtttctccaggggaacgagccaccctctcctgcagggccagtcagagtgtgancagcaacttagcctggtatcagcagaaacctggccaggctcccaggctcctcatctatggtcgccttcccaccaggggcccgctcgggtcgtccccaggcccagtacttcgaggggcaggtgggtccgtgggacngtacgtcactctaccacatcacgcgacgcctgcgtagtctagtaaacgtattttcgacgtaagttttacttacgttcgtactagactaactaagttaactaaccggtccggggtacccccgggggggtacgttaccgggaaccggtaacgggaaccgtaacggggtacgggtaggtacgtaacgaaacggtaaccgtagggttacgaccgtacgaccgtaaccgattccgtacgtttcttctacgtttccccg

SEQ ID NO: 176427 - DNA, 724 bp, Homo sapiens
  misc_feature: GYAE6OF02J0S6S.17.43.D10.1.454.CMB.1.raw
  modified_base (317)..(317): a, c, t, g, unknown or other
  misc_feature (317)..(317): n is a, c, g, or t
tcagcgtagactagcacgaccggtgctcgatttagactagcagtaaggggggagggaactgctcagttaggacccagacggaaccatggaagccccagcgcagcttctcttcctcctgctactctggctcccagatactactggagaaatggtgatgacgcagtctccagccaccctgtcttgtttctccaggggaacgcgcccaccctctcctgaccgagggcccagtcaggagtgtgagcagccaacttgcctggtatcagcaagaaaccgtggaccaggcctccccgaggcctccgtcactcgtagtcggttcnccttaccgaccgcggggtcccgtcgttcgggtcgtccccaggtcccagtacttccggagggcctagggtcgggtacgtggggaactaggtacgttcctacttctaccgaacctagtccgagtccacggtccgtgacgtacgtacgtagtaacgttagttttcggactttagttttaaccttacgttgtaccgtacgtctaacgtttaataaacgttacccgggtacccggggggtcccccggggggttaacttcccggggaaccgtaaaccggggtaaccggtaaacggggtcgggaacgtaccgttaaccgtaaaaccggtaaccggttggttaccggaacgtttaccggacccgttaaccgttacggttacccgtttgttacccggtttaccacggttttccccc

SEQ ID NO: 176428 - DNA, 770 bp, Homo sapiens
  misc_feature: GYAE6OF02IHDAQ.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcgagcaagaaacctggccaggctccgaggctctcatctatggtcgcttaccgaccgacgggccgcgttcgggtcgtccccgagcccagtacgttcgaggggcctaggttggggtctggggaactaggacgtttaccacgttcctaccgacccgtataccgacggaccgacggtcccgttaggacccgtacggttccgttaggtaaaaggtttactttttacggactttaacggtttttaactttaccggtagttaccgaacgtaccgtaaaccgtttaaagttaaaccgttaaacccggggttccccgggggggtaaacccccccggggggggtttaagtttaaccccgggggtaacccggtaaaaacggggggttaacccggttaaacggggttaggggtaaaccggtacggttaaaccggtaaaccgggtaaacgttcgggggttacggaaccggttacggtacccgtaacccgtagtttaccgttacgggttcctttaccgtaacgtttcccccgg

SEQ ID NO: 176429 - DNA, 522 bp, Homo sapiens
  misc_feature: GYAE6OF02HPGSP.17.43.D10.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttcnccaggggaacngccacctctcctgcagggccagtcagagtgngagcagcaacttagcctggtatcagcaagaaacctggccaggctcccaggctcctcatctatggtgcttccaccgagggccgctggtcgtccagccagacttcgagggcaggtcgggtctgggacaggacgttcactctcacctatcagcacgcctgctagtctagaagtnttttgctagtttacttactntcagcactataactacgtcgggacccgggggtacgtccggacgaagggaccaagggtgagatacgaaacgacgtcgtggctgcgacactctcgtcttacactccg

SEQ ID NO: 176430 - DNA, 563 bp, Homo sapiens
  misc_feature: GYAE6OF02HHYYZ.17.43.D10.1.454.CMB.1.raw
  modified_base (183)..(183): a, c, t, g, unknown or other
  misc_feature (183)..(183): n is a, c, g, or t
  modified_base (359)..(359): a, c, t, g, unknown or other
  misc_feature (359)..(359): n is a, c, g, or t
tcagcgtagactagcacgaccggtgctcgatttagactagcagtaagggggaggaactgctcagttaggacccagacggaaccatggaagcccagcgcagcttctcttcctcctgctactctggctcccagatactactggagaaatggtgatgacgcagtctccagccacctgtctgtttcnccaggggacagccaccctctcctgcagggccagtcagagtgtgagcagcaacttagcctggtatcagcagaacctggccaggctcccaggcctcctcatctatggtgccttccaccgacgggcccgcgtggtcgtcccagcccagtattcgaggggcaggtgggtctgggacaggngttcacttctcaccatcagcacgcctgcagtctagaagtatttgacttagtttattacgtgtcagctaacttataataaccggtccggggaccccggggggtacgttccgggaccgaacgggaccgaagggtacggaagtacgtacgaaacgtaacgtaggtacggtacgtcgaccacctacgtcgttcgtcttctacttcccg

SEQ ID NO: 176431 - DNA, 590 bp, Homo sapiens
  misc_feature: GYAE6OF02GISX4.17.43.D10.1.454.CMB.1.raw
  modified_base (204)..(204): a, c, t, g, unknown or other
  misc_feature (204)..(204): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctntcctgcagggccagtcagagtgtgagcagcaacttagccttggtatcagcaagaaacctggaccaggcctcccgaggcctccctcatctagtggtctccttccaccgacgggccgtcgtcggtcgtccccagccagacttcgaggggcaggtcgggtctaggggacaggtacgttcactctcacctatcgagcacgctgctagtctagtaagtatttgacttagtttacttactgttcagtactattaataagtaccggtccggggaccccgggggtacgtccggaccggaaggaccggtaagggtgaagtacgaacgtaaacggtacgtaggtacggtacgtacgaccgtacgtcgtaccgttcgttacgttacctagtttcccc

SEQ ID NO: 176432 - DNA, 831 bp, Homo sapiens
  misc_feature: GYAE6OF02HX5DR.17.43.D10.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccacctgtctgtttcnccgaggggacagccaccctntctgcagggccagtcagngtgtgagcagcaacttagcctggtatcagcaacgaacctggccaggcctaccgaggccttcctactatcgtagttcggtacgtccttccgaccgtacgggcctcggttcggtcctacccgagaccctaagtacgtttacggacggggtcctaggggttcgggggttacgtacgggggactaacgggtacgtttaccgacgttccgttacccaacgttacgttaccgaacggccgtaacccggtccgttacgtaccgtacggtttaccggttaaaggaaacgtttacgttttcggtaacctttaagggtttttaacctttaaccgttacgttaccgtaacgtacccttaaactttaaacgttaaaccggttttaaacccgggccccggggggggtttaccccccggggggttaagtttcccccggggaaacccggttaaaaccgggggtaacccgtaaaggggggtttaccgaaacgggttacccgtaaaccgggtaaaccggttaaccgggttttgggaacccgggttacctaacccgggtaccaaacccggttcgttttcccgggttaacgttttaccccggtttaccggacccttttccccccgg

SEQ ID NO: 176433 - DNA, 577 bp, Homo sapiens
  misc_feature: GYAE6OF02HH9NK.17.43.D10.1.454.CMB.1.raw
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccaggtcagagtgtgagcagcaacttagcctggtatcagcagaaacctggccaggcctcccaggctcctcatctagtggtcgcttccaccgagggccncgtggtcgtcccagccagtattcgagggcaggtgggtctgggacaggagttcacgtctcaccatcagcagctgcngtctgaatntttgntagtttatctgtcagctactataacgtaacgtccggggtaccccggggggtacgttaccgggaccggaaacggggtacccaagggggttacgacggacgtaacgaaaccggtacgtcggtacggtaccttcggacctaccgtacgttccttcggttccttacgtacttccccgg

SEQ ID NO: 176434 - DNA, 561 bp, Homo sapiens
  misc_feature: GYAE6OF02HMOBH.17.43.D10.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
tcagcgtagactagcacgaccggtgctcgatttagactagcagtaaggggaggaactgctcagttaggacccagacggaaccatggaagccccagcgcatcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcaagaaacctggccaggctcccaggctcctcatctatggtncttccaccngggccnctggtctcccagccagattcgagggcaggtgggtctgggacaggacgttcacttctcaccatcagcacgcctgcagtctagaatatttgactagtttacttactgttcagtctactaataacgttaacggtccggggtacccccggggggtacgttccggaccgtaacgggaccgaagggtaggacgtagtacgaaacggtaacgtggtaggaccgtgacctacgtactcgttgttaccttcgtacttacccg

SEQ ID NO: 176435 - DNA, 608 bp, Homo sapiens
  misc_feature: GYAE6OF02FV5IB.17.43.D10.1.454.CMB.1.raw
  modified_base (312)..(312): a, c, t, g, unknown or other
  misc_feature (312)..(312): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccagggggaacagcccaccctctcctgcagggccagtcagagtgtgagcagcaacttagcctggtatcagcagaacctggccaggctcccaggcctcctcatctatggtgccttccaccgagggccnctggtcgtcccagcccagcttcggagggcagggtgggtctggggactaggtagttcactctcgaacctatcagtcacgtcctgactagtctagaagttagtttcgacttagttttattacgttgtctagtctaacttaataaacgttaaccggtcgggggacccccggggggtacgttaccgggaccgtaaacggggaccgtaagggtacggacgtacgtacggaaacggtacgttacggtacggtacgttacggacctaccgacgttaccgtgttaccgttctacgtttaccccg

SEQ ID NO: 176436 - DNA, 754 bp, Homo sapiens
  misc_feature: GYAE6OF02JY64U.17.43.D10.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (509)..(509): a, c, t, g, unknown or other
  misc_feature (509)..(509): n is a, c, g, or t
  modified_base (727)..(727): a, c, t, g, unknown or other
  misc_feature (727)..(727): n is a, c, g, or t
tcagcgtagactagcacgaccggtgctcgatttagactagcagtaaggggagggaactgctcagttaggacccagacggaaccatggaagcccagcgcagcttctcttcctcctgctactctggctcccagatactactggagaaatggtgatcgacgcagtctccagccaccctgtcttgtttacctccgaggggaacncgccaccctctcctggcacgggccagtcagagttcgnggagccaggactaaccgtttagggccctagggttaactcgagtacgaaacgtaaaaccgtcggaccgaacggccgtaccccgaggtcctcccgtacgtactccgttacgtcggtgtacccttccgtacccgacgggtcccgtcgtcgggttccgtacccgacgccaaacggcgtttaccggacggggtacgtcgggtggggttacgtacggggaacgacggttacggtttaaccgccgttaccgtaaccaccgtaacgtcccgttagacccncgggtacccctaggggacctaacgttccgttaggtaaaactttcgttttacggtacttagttttaacgttttctaacggtctaacgtccttaacgtaacgttaacgttaaacggtcccgggggtaccccggggtaccgttccggaaccggtaacgggaacccgtagggtcgaactcggtaaacgaacggtacgtagtacggtcgtaggactaccggtntccggttactcgttaccgacttcccgg

SEQ ID NO: 176437 - DNA, 625 bp, Homo sapiens
  misc_feature: GYAE6OF02H7IYL.17.43.D10.1.454.CMB.1.raw
  modified_base (386)..(386): a, c, t, g, unknown or other
  misc_feature (386)..(386): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagcccaccctctcctgcagggccagtcagagtgtgagcagcaacttagcctggtatcagcagaaactgcagctccaggctcctcactctatggtcgcttccaccgagggccgcgttggtccgtcccacgcctaggacttcgacgggcaggtgggtactggggacaggtacgttcgactctacgacatcgancacgctgcagtctacgtaattagtttcgacttaagttttacttacttggtacagtactaacttaagttaaacttaaccggtccgggcccccggggggtaagttacccggacggaaaccgggtaccggaaacgggttcggaacgtagtaaccggtaaacgaaacggttacggtcggtaccgttacgggacctaacccgtacgttaccgtacggtttaccctttacgaaccgtttccccgg

SEQ ID NO: 176438 - DNA, 645 bp, Homo sapiens
  misc_feature: GYAE6OF02GBHQQ.17.43.D10.1.454.CMB.1.raw
  modified_base (185)..(185): a, c, t, g, unknown or other
  misc_feature (185)..(185): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccgaggggaacagccaccctctcctgcagggccagtcagagtgtgagcagcaaacgttagcctaggtactcgagccaagaaacctggaccaggcctacccgaggcctcctcatcctagtcggtgccttccgaccgacggggcctcgtggtcgtcccgagccagtacttcggaggggctagggtcgggtcgtaggggaacaggtagttcacgtctccgacactcgagtcgacgtcctcgctagttctagaagttctttgacttagtttattacgttcgtacacgtactaacttaagtaaacgtaacggtcccgggggtacccccgggggttagttaccgggaaccgtaaacggggaacccgtaaggggtacgggaacgtacgtaaccggaaaccggtaacggtcggtacggtacctacggcctaaccgtagttcctacggtttccttaccgtacttccccg

SEQ ID NO: 176439 - DNA, 702 bp, Homo sapiens
  misc_feature: GYAE6OF02GKHDF.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccacctctcctgcagggccagtcagagtgtgagcagcaacgttagccttggtatcagcagaacctggccaggctcccaggctcctcatctatggtgccttccaccgagggccgcgtggtcgtcccgagccagattcgagggcaggtgggtcagggacagtagttcactctcacctatcgagcacgcctgctagtcctagtaacgttagttttcgacttaagttttaacttacgttcgttacgtacgtacctaacttaacgttaaacgttaaaccggttcccgggggtaccccccggggggggttaacggtttaccccggggtaaccccggtaaacgggggtaaacccggtaaacgggggttacgggaaacgggttaacgtaacccggtaaaaccggtaaccggtttaacgggttaccgggtacccgttaccggtacccgtaacccggtaccggttttacccgttaccggtttacccgttttacccgtaaccgttttacccccccgg

SEQ ID NO: 176440 - DNA, 735 bp, Homo sapiens
  misc_feature: GYAE6OF02IXWQ3.17.43.D10.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgngccaccctctcctgcagggccagtcagagtgtgagcagactaacttgcctaggtactcagcagaacctggccaggcctccccgagcctccnctatctagtggtcgccttacccgacgcggggcccgtcgtcgggtccgtcccgagaccgtaaggtacttccggaggggtctaagggttcggggttaccgtggggacgtaaggttacgtttaccacgttccgtaaccaaccgtactaccgagtaccgacgtcccgtgaccgtagtaccgttaagtaacgttagtttttcggacctttaaggttttaattacgttagttaccgtacgtaaccttaacttaacgtaaacggtttaacccggggtcccggggggtaacccccgggggggttacggttacccggggaaccgtaaaccggggaaccggtaaaggggttacggggaccgtaacgtaacccggtaaacggtcggttacgggtaccggtctacgggtacccaacggttactttaccgtcggttacctttaccgaccgtttaccccg

SEQ ID NO: 176441 - DNA, 606 bp, Homo sapiens
  misc_feature: GYAE6OF02HVJQ2.17.43.D10.1.454.CMB.1.raw
  modified_base (415)..(415): a, c, t, g, unknown or other
  misc_feature (415)..(415): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagccaccctctcctgcagggccagtcagagtgtgagcagcaacttagcctggtatcagcaagaaacctggaccaggctcccgagcctcctcatctagtggtcgcttccgaccgagggcccgctgggtctcccagccagtacttcgagggctaggtgggtctcggggaacaggacgttcacttctacgaccatacgagcacgcctgcagtctagtaagtnttttcgattagtttattactgttcagtacaacttaataacgttaaccggtccggggaccccggggggttacttaccggggaccgtaacggggacctaaagggtgaacgtacgtaaccgaaacgtaggttacggtacggtaccgtacggaccgaccgtacgttccttacggttaccgtttaccacgttcccg

SEQ ID NO: 176442 - DNA, 679 bp, Homo sapiens
  misc_feature: GYAE6OF02H60LD.17.43.D10.1.454.CMB.1.raw
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagcccaccctgtctgtttcnccgaggggaacngcccaccctctcctgcagggccagtcaggagtgngagcagcaacttagcctggtatcagacaagaaacctggaccaggcctccgaggcctcctacatctaagtcggtcgtccttacccgaccgacgggcccgtcgttgggtacgtccccgagccctagacgttcggaacggggctagggtcggggtctaggggactaggtacgttccgaactccgtcaacccgtataccagcacgtccctgcacggtactagaagttactttggacttaagtttactttacgtgtactagtactaacttaacgttaaacgtaaaccggtcccggggtacccccgggggggtaaccggttaccgggaacccgggtaaacggggaaccggaaacgggtagggaacgaacggttaacgaaacggtacgtacggtacggacctacggaccgtaaccgtacgtaccgttacggtaccgtttaccgtacgttaccccg

SEQ ID NO: 176443 - DNA, 863 bp, Homo sapiens
  misc_feature: GYAE6OF02G5CSX.17.43.D10.1.454.CMB.1.raw
  modified_base (196)..(196): a, c, t, g, unknown or other
  misc_feature (196)..(196): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggacngccaccctctcctgcagggccagtcagtgtgtgagcagcaacttacgccgttaggtatcgagtcaacgaaaccgtggaccacggcctacccgaggccttacctcgtacttccgtagttcgggttacgtccctttacccgaccggtacggggccccgtcggttcgggttaccgtaccccgaaggtccccgtaaggtacgtttccgggaagggggtcctaacggggtttcggggtaccggtagggggaacctaggtacgtttaccaacgttcctaccgaacctacgttaccgacggtaccgtaaccggtccgttacggtaccgtaacggtttaccgtaaggtaaacgtttacgttttttaccgggaacttttaacggtttttaaccgtttaaccggttcggttaaccgaacggttaacctaaacgtttaaacggttaaaaccggtttaacccggggtacccccggggggggttaacccccgggggggttaaccgttacccgggggaaacccggtaaaccggggggtaaaccctaaacggggggtacggtaaaccggtaccgttaaaccggaaaacccggttcggtttacgggtacggtaccggttaccgtaccggtaaccgttcgttaccggtttaccgtttacccttacccgtaccgtttacccccgg

SEQ ID NO: 176444 - DNA, 673 bp, Homo sapiens
  misc_feature: GYAE6OF02I1QT9.17.43.D10.1.454.CMB.1.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
tcagcgtagactagcacgaccggtgctcgatttagactagcagtaagggggaggaactgctcagttaggacccagacggaaccatggaagccccagcgcagcttctcttcctcctgctactctggctccagatactactggagaaatggtgatgacgcagtctccagccaccctgtctgtttctccgaggggaacagccaccctctcctgcagggccagtcagagtgtgagcagacaacttagcctggtatcagcaagaaacctggccaggcctcccgaggtcctcctcatctagtggtcnccttccgacgngggcctcgtgggtcgtcccaggccagtacttcggagggcgtaggtcgggtcgnggggaacagtcgttcacgtctcaacctntacagccacgcctgctacgtctaggtaattagtttggactttagtttaactttacgtagtacgtacgacctaacgttaacttaacgttaaacccggtcccgggggggtaccccggggggttaacgtttaccggggaacccggtaaacggggtaaacccgtaaggggtacggtaacggtaccgttaaccggaaaacggtaaccggttcggttacgggtacctacggtaccctaacggttaccgttacgttcgtttacccgtttaccgtactttacccccgg

SEQ ID NO: 176445 - DNA, 620 bp, Homo sapiens
  misc_feature: GYAE6OF02GZGYQ.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgccagggccagtcagagtgtgagcagcaacttagcctggtatcagcagaaacctggccaggctccaggctcctcatctatggtcgcttccaccgagggccgctgggtctcccagcccagtacttcgaggggctaggtgggtctaggggacaggtacgttcactctcaccatcagcacgcctgcagtctagaagtacgttttgcttaagtttacttactgtcagtactactaataacgttaaccgtccggggacccccgggggggtagtttaccgggaccgtaaacggggtaacccgtaaggggtacggaacggtacgttaaccggaaaaccgggtaacgttacgggtacggccgttacggaccgtaaccgtaacgttccggtacggtttcctttaccgtacgttccccg

SEQ ID NO: 176446 - DNA, 713 bp, Homo sapiens
  misc_feature: GYAE6OF02JUW70.17.43.D10.1.454.CMB.1.raw
tcagcgtagactagcacgaccggtgctcgatttagactagcagtaagggggagggaactgctcagttaggacccagacggaaccatggaagccccagcgcagcttctcttcctcctgctactctggctcccagatactactggagaaatggtgatgacgcagtctccagccacctgtctgtttctccgaggggacgagcccaccctctcctgcgagggccaggtcaggacgttgcggagcagcaacttgcctggatcgagtccaacgaacctggcacggctcccgaggcctccgtacattcgtagtcggtcgtccttacgaaccgacggggcctcgttcgggtcctaccccgagggtccccaggtacgttccggacggggtcctacggggtacggggttccgtacggggaactacgggttacttccggaccgtttactacccacgacgttaccgtcggaccgtacggtcccctaggtcccgaagggttcccgttagaaacggtttccgttttaacggccgtttaagggtttttaacttccggtagttaccgacggtaccttaaacgtaacgttaaccggttaaccgggcccggggggttaccccggggttacggccggtaacggtacggtaacggagggttccgaagttcaacggtaaacgcggttggacggaccttcggactacggtagtctacggtactccgtattccccg

SEQ ID NO: 176447 - DNA, 787 bp, Homo sapiens
  misc_feature: GYAE6OF02F2144.17.43.D10.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttcnccgaggggaacngccaccctctcctgcgagggccagtcagagtgtgagcagctaacttagcctggtatcagcaagaacctggccaggcctcccgaggtcctcctcgactcgtagtcggtcgtccttacccgaccggtacggggtcccgtcgttcgggttaccgtccccgaacggtaccccgaaggtaccgtttaccggacggggggtacctaacggggtttcggggttaccggtacggggtaaacccgtaacggggttaacggtttcccgtaaccgttaccccgttacccggaaacccgttaaccgttaccggaaccggtaccgtaaccggtacccgttaccggtaccggtacggttaccggttaacggtaaacggttacgttttacggtacgtttacgtttaacgtttacgttacgttacgtacgtacgtaacttaacgttaacgtaacggtacccggggtacccgggggtaccggtaccggtaccggaacgggacggtaacggtacggtacggtacgtaacgaacggtaacggtacggtacggtacgtacgtacgtacgtacgttacgacgtttttttttttccgtaccgttacgttacccg

SEQ ID NO: 176448 - DNA, 757 bp, Homo sapiens
  misc_feature: GYAE6OF02F13DG.17.43.D10.1.454.CMB.1.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
  modified_base (639)..(639): a, c, t, g, unknown or other
  misc_feature (639)..(639): n is a, c, g, or t
  modified_base (698)..(698): a, c, t, g, unknown or other
  misc_feature (698)..(698): n is a, c, g, or t
tcagcgtagactagcacgaccggtgctcgatttagactagcagtaagggggaggaactgctcagttaggacccagacggaaccatggaagccccagcgcagcttctcttcctcctgctactctggcctcccagatactacgtggagaaatggtgatgacgcagtcctccagcctaccctgtcttgtttcnccgaaggggacngcccacctctccgtgcgacgggccagtcaggtgtagtgacncgagactaacgttcgctaggtactcgancgaacgaaccgtcggacctacggtcctcccgaggtcccttaccgttacgacttccgttaaggtcggtaccgtcccttaccggaaccggtccgggtcctcgttcggaccgttccccgaggacctaagttacgtcgggacgggtacgtagggttcgggacgttgggaacctacgggtacttaccgacgtttcctaccggtaacctaggtaccgaccgtacgtaaccgtcccgttaggaccgtaacgttcggttaaggtaacgtttcgttacgtacgttttaacggtttaacctaggttacccgtcgtaacgtaccttttaagtaaaccgttaaccgtacggggggtccccgggtacccgggggtttaacnccggtaaacccgggaaggtaccggtaacgggtacgtaccgtaagaccgtaaaccgggtntcgggtacgtacgacgtccctaacggtcttaccgttacgtccgtacgttaccgtacccg

SEQ ID NO: 176449 - DNA, 660 bp, Homo sapiens
  misc_feature: GYAE6OF02FENGW.17.43.D10.1.454.CMB.1.raw
  modified_base (314)..(314): a, c, t, g, unknown or other
  misc_feature (314)..(314): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacagccaccctctcctgcagggccagtcagagtgtgagcagcaacttagcctggtatcagcagaaacctggccaggcctcccgaggcctcctcatctatggtgtccttccaccgaggggccncgtggtctccccgagccgagtacgttcgaggggcaggtgggtcgtggggacaggtacgttcacttcctccacctatcacgcacggtcctgcgtacgttccgtagtaacgttattttcgacgtttaagttttacttacgttcgtcacgtctaacttaacgttaaactaacgggttacccggggggtacccccggggggggttaacgttcccggggtaacccgaaacgggtaacccggtaagggtacgggaacgtacgtaaccgaaacggttttaaccgcgggtacgggtccgttacggacccgtaccgtacgttacccgttcgttccttaccgtaccgtttcccccg

SEQ ID NO: 176450 - DNA, 610 bp, Homo sapiens
  misc_feature: GYAE6OF02GBJGQ.17.43.D10.1.454.CMB.1.raw
  modified_base (295)..(295): a, c, t, g, unknown or other
  misc_feature (295)..(295): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaacctggccaggctccaggctcctcatctatggtcncttccaccgagggccgctggtcgtcccagccagacttcgaggggcaggtgggtctgggactaggacgttcacgtctcaccatcagcacgtcctagcagttcagtaagtattttgacttagtttattactgttacacgtctacttaattaacgtaaccgtccgggggtacccccggggggtagtttacccgggaccgtaaacgggaccgtaaacggggtagggaacgtacggtaccggaaaccggtacgttacggtacgggtccttacgaccgtaaccttaacgtccggttacgttcccttacgtactttaccccg

SEQ ID NO: 176451 - DNA, 861 bp, Homo sapiens
  misc_feature: GYAE6OF02ITPF1.17.43.D10.1.454.CMB.1.raw
  modified_base (152)..(152): a, c, t, g, unknown or other
  misc_feature (152)..(152): n is a, c, g, or t
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtnatgacgcagtctcagccacctgtctgtttccncgagggacagccacctctccngccgacgggccagtcagagtntgagcagcaatacgctgatcagacagaacctggaccaggcctccgagtcctacncaattctagtacggtcgtccttaccgacggacgggtcctacgttcggtaccacccgtaaggcccgtaaggtacgttccggacggggtactaacggggtttgggtaccgtaggggtaaaccgaggttaacgtttacccaccgtttactaacccgacctacgttacgaaccggtaccgtacggtaccctacgggtaacctacgggttaccgttaaacggttaaacggtttacggttttaacgaacccggttttaaaggtttttttaaacccgtttaacggttacggtacccgttaacgttaaacccgtaaaattttaaacgtaaaaccgggtttaacccggggttaaccccggggggggtaacccccggggggggtttaactttaacccgggggtaaacccgggtaaaacgggggtaacccggttaaacgggggttacggtaaacggttaacggtaacgggtaaaaaccgttaacgggttcgggtaacccgggttaaacgtccgggttaaaacccgaaaccgtttccgtttaaccggttaaccggtttaccccgtttaaccgttaccccgtttaacccccggg

SEQ ID NO: 176452 - DNA, 696 bp, Homo sapiens
  misc_feature: GYAE6OF02IC02W.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccagggaacagccaccctctcctgcagggccagtcagagtgtgagcagcaacttagcctggtatcagcagaaacctggccaggcctccgaggctctcatctatggtcgtccttcccgaccgacgggccgcgtcggtcgtacccaggcccagtacttccgaggggcctaggttcggggtcgtaggggaactacgggtaacgtttccgaaccgttcctacccgtaaaccctacgtttacccgaacggaccgtaacggtccccgttacggaccgtaaacggtttccgttaaggtaaacggtttaaacgttttttcgggtacctttaaagggttttttaactttaccgttacggtacctaacggtacctaacgttaactaaacgttaacggttcccggggtaccccggggggtacgttacgggaccgtaacgggaccgaagggtgaacgtagaccgtaaacggactacggacggtactagacctaccgtactccgttacgtcttacaccttcccg

SEQ ID NO: 176453 - DNA, 547 bp, Homo sapiens
  misc_feature: GYAE6OF02FRX1C.17.43.D10.1.454.CMB.1.raw
  modified_base (416)..(417): a, c, t, g, unknown or other
  misc_feature (416)..(417): n is a, c, g, or t
  modified_base (523)..(523): a, c, t, g, unknown or other
  misc_feature (523)..(523): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaaacctggccaggctcccaggcctcctcattctatggtgcttccaccagggccgctggtctcccagccagattcgagggcaggtgggtctgggacagagttcactctcacatcagcagcctgctgtctgacgtattttcgcttagtttatacttgtcnnctactaatataacgtccggggaccccgggggtacgtccgggaccgaacgggaccgaagggtcggacgtacgtacgaaacgtacgtaggtcggacgtgacctaccgnttccgttagtcttctagttccccg

SEQ ID NO: 176454 - DNA, 633 bp, Homo sapiens
  misc_feature: GYAE6OF02J1VJU.17.43.D10.1.454.CMB.1.raw
  modified_base (146)..(146): a, c, t, g, unknown or other
  misc_feature (146)..(146): n is a, c, g, or t
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (437)..(437): a, c, t, g, unknown or other
  misc_feature (437)..(437): n is a, c, g, or t
tcagcgtagactagcacgaccggtgctcgatttagactagcagtaagggggaggaactgctcagttaggacccagacggaaccatggaagccccagcgcagcttctcttcctcctgctactctggcctcccagatactacgtgganaaatggtgaatgacgcagtctccagccaccttgtctgttaccnccgaggggaacngccacctctctgcagggccagtcagngtgtcgancagtaccaacttggcctggtancacgcaacgaaccgtgcctaggcctaccgacggtcctaccgttcaagttcgtagtcgtacgcttacccgacgacggtccgcgttcggtcctaccgcgcgtagaccgttcggaacgggtctacgggttcggcgtaggcgagtacgtcactcgactcatcacgtcacgcgtcgcgtacgttntagacggtttcttcgtatacgttttactcgtcgtacctacgtactacgttaacgtactaccgggtacccggggtacccgggggtactaccgggtaaccgacgggtaacgagggttcgaaggtaccacggtaacgaaccggttggacgacgtaccgctacgtacgttacgttcgtaccgttccgtacgtttccccgg

SEQ ID NO: 176455 - DNA, 685 bp, Homo sapiens
  misc_feature: GYAE6OF02FYJDV.17.43.D10.1.454.CMB.1.raw
  modified_base (289)..(289): a, c, t, g, unknown or other
  misc_feature (289)..(289): n is a, c, g, or t
  modified_base (403)..(403): a, c, t, g, unknown or other
  misc_feature (403)..(403): n is a, c, g, or t
tcagcgtagactagcacgaccggtgctcgatttagactagcagtaagggggaggaactggctcagttaggacccagacggaaccatggaagccccagcgcagcttctcttcctcctgcctactctggctcccagactactactggagaaatggtgatgacgcagtctccagccaccctgtctgtttctccaggggacagccaccctctcctgcagggccagtcagagtgtgagcagcaacttagcctggtatcagcaagaacctggaccaggcctcccgaggcctcctnatctagtcggtagccttcccaccgagggcccgcgttcgggtcgtccccgagcctaggacttccgaggggcctagggttcggggtctaggggacaggtagttccactctacaccntcagcagcctgctagtcctaggtaagttagtttcgacttagtttacttacttgtcagtactaacttaattaacgtaaccggtccggggtacccccggggggttaagtttcccgggaaccggtaaacggggtaaccccgtaaagggggtaccgggtaacgtaaccgtaaccggtaaaaccggttaacggttcggggttaccggtaaccgtttccggaacccgtaaccgtttaccggttaccccggttacgtttccccgttaccgttaccccgtttccccccgg

SEQ ID NO: 176456 - DNA, 717 bp, Homo sapiens
  misc_feature: GYAE6OF02HFQST.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttcctccgaggggaacgagcccaccctctcctgcgagggccagtcagagtgtgagcagactaacttacgccttaggtactcgacgcaacgtaaacccgtggacccaacgggtccctaccccgagggtcccttaccctacgtattccgttaagttcgggttcgtccttacccgaccggacggggtcccgtcgttcgggtccgtaccccgacggcccgtacggtacgttccggacgggggtcctaaggggttcgggtcggtacggggacgtaggtcgttactaccgtctaccacgtactcgacgcgacgtcctgacgtacgtacgtaagtacgttagtttcgacgttagtttattacgtgtacagtactaacttaagtaacgtaccgggtccggggtaccccggggtagttaccgggaaccgtaacgggaccgtaagggtacggaacgtacgtaaccgtaaacggtacgttagggtcgtaccgtacgtacccgtacctacggttccgttacggtttaccttacgtaccgttccccg

SEQ ID NO: 176457 - DNA, 771 bp, Homo sapiens
  misc_feature: GYAE6OF02H9OA1.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctcgaggggacagccacctctctgcgacgggccagtcagagtgtgagcagcaacttagcctggtactcagcaacgaaaccgtggaccaggcctacccgaggtcctcccgtacactccgttagtcgggttacgtcccttacccgaccggacgggggtcccgtaccgttcgggttacccggtaccccgacggtaccccgaggttacggttacccgggaagggggtaccgttaggggttccgggggtacgtacgggggtaactaggtaacggttccctaacgttaccgtacccgaaacctagttacccgaacggtcccaacggtcccgtgaccggacgttcgttaaggtaacgttagttttcggtactttaagttttacttacgttacgtactacgtacaaactttaacgtaaaccggttaccgggttcccggggggaccccgggggttacgtttaacccgggaaccgggtaacggggtaccggaaaggggtcggaacgttaacgtaccggaaacggttcggtacggttacggggtcttaaccgaccgttccacggttacctttccggtactttacccgagtttacccccgg

SEQ ID NO: 176458 - DNA, 675 bp, Homo sapiens
  misc_feature: GYAE6OF02I7MS2.17.43.D10.1.454.CMB.1.raw
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcaagaacctggccaggcctcccgaggctcctnatctagtggtntccttaccgaccgagggcctcgtggtcgtcccagccagtacttcggagggctaggtgggtctaggggactaggtacgttcgactcgtaccaacctagtccgagtccgacgtcctacgccgtagttccgtaggtaacgttagttttcgactttaaggttttacttaccgttgttaccgtacgtacctaaacgtttaagtaaaccgttaaccggtcccggggggtacccccggggggtacgtttacccggggaccggtaaacgggaaccgtaacggggtacggaacgtacgtaaccggaaaccggtacggttacggtacggtaccgtacgtaacccgtaccgtcgttaccgttacggttaccctttaccgtccttaccccg

SEQ ID NO: 176459 - DNA, 776 bp, Homo sapiens
  misc_feature: GYAE6OF02HVMXF.17.43.D10.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagcccaccctgtctgtttcnccgaggggaacngccaccctctccgtgcgagggccagtcagagtgtgagcagctaattagccgtggtatcagcaagaaacctggccaggcctccgaggtctcctcatctagtcgtgtcttccgacgagggccgacgtcgggtccgtacccgacgaccgagtacgttacggaggggtcctagggttgggtccgtaggggaacgtaaggtaacgttccgtaacgttcctacgaacccctaagtaccgaagtcccgaacggtcccgttcggaacgtaacggttccgtaaaggttaaacggttaacgttttttcggaactttaaacggttttttaattacccgtttaacggttccaaggtaacccctaaagttaaacgttaaaacggttaaccgggtcccgggggggtaacccccggggggttacgtacccggggaaccggtaaacgggggtaaccctaaagggggtacggaacgtaacgttaaccgtaaaaacggtaccggtttagggtaaccggtacgttaccggaacccttaacccgtaacggtttacccgttaaggttttaccccgttacgtaaacccgttttcccccgg

SEQ ID NO: 176460 - DNA, 818 bp, Homo sapiens
  misc_feature: GYAE6OF02IV13I.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgaggggaacgagcccaccctctcctgcagggccagtcagagtgtgagcagctaactgcctggtatcagcacgaaaccgtggccaggcctcccgaggcctcctctatctagtggtcgtccttccgaccgacggggcccgcgttcgggttccgtcccgacggcccgtaaggttacgttccggacgggggtacgtaggggttcgggggttaccgtacgggggtacgaagggttacgtttaccgtaacccgtttccgtacccgtaacccgtacgttcccgaacggtacccgaacggtcccgtacggtacccgtaacggtttccggtaaagttaaacggttacttttttcggacgtttaacgttttaactttaacggttcgttacaacggtacctaaacgttaacgttaaaaccgttacccggggttacccgggggggtaccccccggggggggtttaattccccggggtaaacccggtaaaaccggggggtaacccgtaaagggggtaaccgggtaagggtaaccgtaacccgggtaaaacggtaacggtttaccgggacgggtaccgttacgggtaaccctaaccggttacgtttaccgttcgtttacccgtttacttacccggtttacccccg

SEQ ID NO: 176461 - DNA, 642 bp, Homo sapiens
  misc_feature: GYAE6OF02JFOKK.17.43.D10.1.454.CMB.1.raw
  modified_base (146)..(146): a, c, t, g, unknown or other
  misc_feature (146)..(146): n is a, c, g, or t
  modified_base (198)..(198): a, c, t, g, unknown or other
  misc_feature (198)..(198): n is a, c, g, or t
  modified_base (415)..(415): a, c, t, g, unknown or other
  misc_feature (415)..(415): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactgganaaatggtgatgacgcagtctccagcccacctgtctgttctccgaggggaacngcccaccctctctgcagggccagtcagagtgtgagcagacaacttagccgtggtatcagcaacgaaacctggaccaggcctacccgaggtcctccgactatacctagtcggtcgtcccttacccgaacgcgggtccgtcgtcgtcgtcccagccagtagttcggacgggtcagggtgggtacgtgggactacgtacgttcacgtacctcaaccgtanacgagtcacgtccgtgacgtagtcctaaggtactttgttacggtactttaggttaactcgtcgtaccgatactaacttaacgtaaccggtaacgggtcccggggaccggggttacctaccggggaaccgaacgggtaaaccggtaggtaagtaccggaacgaaccgtaaagtcggaggtcgtacgacgtaccgcgttatccgttcgtaccttacgtaccgttacccg

SEQ ID NO: 176462 - DNA, 827 bp, Homo sapiens
  misc_feature: GYAE6OF02GKX56.17.43.D10.1.454.CMB.1.raw
  modified_base (184)..(184): a, c, t, g, unknown or other
  misc_feature (184)..(184): n is a, c, g, or t
  modified_base (252)..(252): a, c, t, g, unknown or other
  misc_feature (252)..(252): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttcnccgaggggacgagcccaccctctcctgcagggccagtcagagtgtgagcagctaacttgcctggtacncagacaagaaaccgtggaccacggcctacccgaggtcctcctctacttctagtggtcgtccttaccgaaccggacgggccgtacgttcgggttccgtaccccgaaggtacccgtaggtacgttacgggacggggtcctaggggttcggggtaccgtacggggaactagggtacgtttccgaaccttcctaccaaccctaagtaccgaacggtccgtaacggtcccgttaggaccgttaacggttctaaagggttaaacgtttacgtttttacgaacgttttaaggtttttaactttaccgttacggtaccgtaaacgttaccttaaacgtttaaacgttaaaccgggtttaaccccggggttaccccggggggggttaacccccgggggggttaacggtttaccccgggggaaacccgggtaaaaccgggggtaaacccggtaaagggggttaaccggtaacgttaaccgtaaacccgggtaaacggtacgggttacggtaccgggtaacgttaccggaacccgtacgttacgtttaccggttaccgttttaccttaccgtaccgtttcccccgg

SEQ ID NO: 176463 - DNA, 799 bp, Homo sapiens
  misc_feature: GYAE6OF02IENR3.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccgagggacgagcccaccctctcctgcagggccagtcagagtgtgagacagcaacttgccgtggtaatcgaagcaagaaaccgtcggaccaggcctccccgaggtccttacctctaatccgtaagttgggtccgtccttacccgaccggtacgggcccgtccgtttgggccgttacccgagtacccgtagtaacgtttcggaacggggtcctaggggttcgggtcgtcggggaaactacggtaggttacccaactcccttaccgaaaccgtactaccgaaggtacccgtacgtacccgtcgtaaccgtacggttacgtaagtaaacggtttacgttttcggtacctttaaggttttaacgtttacgtacggttaccgtaacggtacctaaaccgttaaagttaaaccgttaaaccggggttaccccggggggtaccccccgggggggttaacggttaaccgggaaacccgggtaaaccggggtaaacccgaaaggggtaacggtagtaaacccggttaaccggaaaaccggttaacgtaacgggtaccggtaccggttaacgacccgttaaccgtaacgttcgtttaccggtccgtttacgtacctttaccccg

SEQ ID NO: 176464 - DNA, 703 bp, Homo sapiens
  misc_feature: GYAE6OF02G0IXM.17.43.D10.1.454.CMB.1.raw
  modified_base (195)..(195): a, c, t, g, unknown or other
  misc_feature (195)..(195): n is a, c, g, or t
  modified_base (320)..(320): a, c, t, g, unknown or other
  misc_feature (320)..(320): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggacngccacctctcctgcaggccagtcagagtgtgagcagcaacttagcctaggtatcagcaagaaacctggaccaggcctacccaggcctctacgatctagtgtcgaccttccgaaccgaggggtccncgttgggtcctacccaggacccaagtacgttacggacgggggtctaggggtcgggtacgtcggggaactaggtaccgttcaaccgttctaccaaaccgtctacgagacgaacgtcctcgacgtaacggtcttacgaaagttacttttagaccgttaagttttaacgttacgttgtacgtacgtacctaaacgtttaaactaaacggttaacggttacccgggggtaacccccgggggggtaagtttaaccccggggaccgtaaaccggggtaaccgaaacggggttacggaacggtaacgtaaccgaaacggtaacgttacggtacggacgttaccggatacccgtagttacccgttggttaccttaccgtacgtttaccccg

SEQ ID NO: 176465 - DNA, 839 bp, Homo sapiens
  misc_feature: GYAE6OF02G1QSF.17.43.D10.1.454.CMB.1.raw
  modified_base (184)..(184): a, c, t, g, unknown or other
  misc_feature (184)..(184): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtcctccagccacctgtctgttcnccgagggaacagccctaccctctcctgccgagggccagtacagtagtgtagagacagacgtaacgttagccctaggttaactccgaaggacctaacgaaaccgtggaccacgggtaccctacccgacggtccttaccctacgtagttactacggttcgggtccgttacccgttacccgaacccgggaccgggggtcccctcggttacggggttaccccgtaccccgacgggtacccccgtaaaggtccgtttaccggggaacgggggtacctaacggggggtttcggggtaccggttacgggggtactaaccgggttacgtttaccccgaaccctttccgtaaaccccgaccttacgtaccggacgtacccgaccggtcctaacggtacgtaacggttacgtacgggtaaagtttctttttaccggacgtttaacgttttacgtttaccgttaggttacctacggtaaccttaaacgttacgttaaaaccgggtacccgggttaccccggggggtacccgggggtaccttaaccggggaacccgtaaacggggtaaaccgtaacggggtacgacgtaccgtaaaccggaacggttcgtacgggtctccggtacgaccgttacgtacgttcggtactttcgtacttacccgtcccg

SEQ ID NO: 176466 - DNA, 770 bp, Homo sapiens
  misc_feature: GYAE6OF02I61FK.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccacctgtctgtttctccgaggggaacagcccaccctctcctgcagggccagtcagagtgtgagcagccaacttagcctggtactcagacaagaaacctggaccaggcctaccccgaggtcctccctctacttccttagtcgggttcgtccttacccgaccggtacggggccccgtcggttcgggtccgttaccccgacggtacccgaggtacgttcggacgggggtctagggttcggggtcgtacggggaactagggttacgttccaacgttcctaccaacccgtattacccgaaggcctaacggtcccgtacgacgtacggttccgtaaggtaacggtttattttcggactttaagtttttaacgttaccgttacgtacctaacgtacctaaacgtttaacgttaaacggttaacccgggttacccggggggtacccccgggggggttacgttacccggggaaccgggtaaaccggggtaacccggtaaggggttacgggaacgtacgtaaccggaaacggtaccggtacgggtacggtaccgtaccgtaccgtaacccgtcgtttaccgttccgttaccgttaccgtaccgtttccccg

SEQ ID NO: 176467 - DNA, 770 bp, Homo sapiens
  misc_feature: GYAE6OF02GSTXB.17.43.D10.1.454.CMB.1.raw
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccgaggggaacagccaccctctcctgcagggccagtcagagtgtgagcagcaacttagcctggtatcagcaagaacctggccaggcctccccgaggtcctcctacatctagtcggtcgtcctttacccgacccggacggggtcccgtcgttcggggttccgtccccgaaggtccccgaaggtacctttacgggaacgggggtcctaacgggggttcggggttccggttagggggaaactaggggtaaccggtttaccgaacccgtttcccgtaccaaacccgtacgtaccgaacgtaccgtaacggtcccttacgggacctaggttaccgtaggtaaacgtttagttttcggactttaaggtttttaacttacgtttcggttacgaagtacctaacgtttaaagttaaacggttaaccgggttccccgggggggtaacccccgggggggtttacgttaccggggaacccggtaaacggggtaccgtaagggtacgggtaacgtacgtaaccggtaaacggtacgttcggtacggaccgtacgaccctacgtcgttacgttccgttactttaccctacgtttacccg

SEQ ID NO: 176468 - DNA, 641 bp, Homo sapiens
  misc_feature: GYAE6OF02IK2H7.17.43.D10.1.454.CMB.1.raw
  modified_base (196)..(196): a, c, t, g, unknown or other
  misc_feature (196)..(196): n is a, c, g, or t
  modified_base (323)..(323): a, c, t, g, unknown or other
  misc_feature (323)..(323): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagcgtagactagcacgaccggtgctcgatttagactagcagtaagggggaggaactgctcagttaggacccagacggaaccatggaagccccagcgcagattctcttcctcctgctactctggctcccagatactactggagaaatggtgatgacgcagtctccagccaccctgtctgtttctccaggggaacngccacctctctgcagggccagtcagagtgtgagcagacaacttgcctaggtactcgagcaagaaacctggccaggcctcccgaggcctcctcgacttctagtggtcgtcttacccgaccgagggccncgtggtcgtcccgagcccagtcgttcgagggcaggtgggtcgngggacnggtacttcacgtctacacctatcgacgcgacgtcctcgactacgtacgtagtaagttatttcgacgtttagtttacttacgtgttacagtactaacttaacgttaacgtaaccggtcccgggggtaccccggggggttaacgttccggggaaccgtaaaccgggggtacgtaaacggggtagaacggtacgtaaccggtaaaccggtaacgttcggtacggtaccgtacgtaccaccgtacgttcttcggttacttcgtaccgttcccg

SEQ ID NO: 176469 - DNA, 726 bp, Homo sapiens
  misc_feature: GYAE6OF02IYLI2.17.43.D10.1.454.CMB.1.raw
  modified_base (187)..(187): a, c, t, g, unknown or other
  misc_feature (187)..(187): n is a, c, g, or t
  modified_base (429)..(429): a, c, t, g, unknown or other
  misc_feature (429)..(429): n is a, c, g, or t
  modified_base (461)..(461): a, c, t, g, unknown or other
  misc_feature (461)..(461): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtagatggacgcagtctccagccaccctgtctgtttccnccgaggggaacacgcccaccctctcctgaccgagggccagtcaggtatggtgagccagacctaaacgttgccgtagtatccagacaacgtaaacctggaccgaacggcctacccgaggccttaccctacgtacttcgtaagttcgggtcgtccttacccgaccggaggggcccgtacgttcgggtactaccccgagtccccgagtacgttacggagggtccagggttcgggacgtcgggaanacggtacgttacacgttacctaccgaaccgtntaccgaacgccgtaaaggtcccctaggaaccgtacgttacgtaacggtaaagtttacgtttttcggaacctttaaaggttttacctacgttacgtaccgtaacgttacaacgttaaagttaaaccgttaaccgggtcccgggggtaaccccgggggtagttacccggaaccgaaacgggtacaagggttagaacgtacttaaccggaaacggtactggaagaccgtgacccgactaggttccgtacgtctttaccgcgttacccg

SEQ ID NO: 176470 - DNA, 579 bp, Homo sapiens
  misc_feature: GYAE6OF02HN6M0.17.43.D10.1.454.CMB.1.raw
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccgagctcctcatctatggtgcttccaccagggccgcgtggtgtcccagccagnttcagggcaggtgggtctgggacagacgttcactctacactatcganacagccngcagtctagaagtattttgctagtttattacgtgtacagtacactaagtaaactaaacgtccgggaccccggggggtacgttccggaccgtaaagggaacccgaaggtagggaagtaacgtacgaaaaccggtaacgttacggtggtccgtacgtaccgtacccgtaagtccgttacgttaccgttctacgtttccccg

SEQ ID NO: 176471 - DNA, 639 bp, Homo sapiens
  misc_feature: GYAE6OF02F0027.17.43.D10.1.454.CMB.1.raw
  modified_base (184)..(184): a, c, t, g, unknown or other
  misc_feature (184)..(184): n is a, c, g, or t
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttcnccaggggaacagcccacctntcctgcagggccagtcagagtgtgancagcaaacttaggcctggtatcagcagaaacctggccaggctcccaggctcctnatctatggtgtccttccaccgaggggccgcgtggtcgtcccagccagacttcgaggggcaggtgggtcgtgggacagtacgttacacttctacacctatcagtctacgcctgctagtcgtagtaagtattttgacttagttttaactacgttgtactagactacgtaaattaaacgtaaccgttcgggggaccccccgggggggttacgttaccgggaacccgtaaacggggtacccgtaaaggggttacggaacggtacgtaacgtaaaccggtaacgttacgggttacggtaccgttacgaccgtaaccgtacgttacccgttaggttaccgtttaccgtaactttcccccgg

SEQ ID NO: 176472 - DNA, 822 bp, Homo sapiens
  misc_feature: GYAE6OF02IFJ9E.17.43.D10.1.454.CMB.1.raw
tcagcgtagactagcacgaccggtgctcgatttagactagcagtaagggggggaggaactgctcagttaggacccagacggaaccatggaagccccagcgcagcttctcttcctcctgctactctggctcccagatactactggagaaatggtgatgacgcagtctccagccaccctgtctgtttctccgagggaacgagccctaccctctcctgcgacgggccagtcaggtaggtgtggagcaacgcaaacgttagccttaggtatcgacgactaacgaaaaccgtcggaccaacggccgtaccccgaggtccttcccgtactattccctaagttcggttacgtccttcccgaaccgtacggggccctacggtcggttcgccccgtagcctaggtactcggtaacgggccgtagggttcgggtacgtcgggaactaaggacgtttacgaccttaccgtccgaaccctacgttaccgaacgaccgtaacggccctttacgacgtacgttacgtaaggtaaaggttacttttacggtaaccttaaagttttttaacgtttacgtccggttaacgtacgtaactaaactttaaacgttaaacggttaacccgggttccggggggacccccggggggttaagtttacccggggaaacccgttaaaacgggggtaaaccccggtaaaggggttaaccggaacggtaacccgttaaaccggtaaaaccgggtaccggttaagggttaccgggtacccgttaccggtaaccgaaccgttcggtttaaaccgtccggtttttaccccgtacgtttaccgttaccccccg

SEQ ID NO: 176473 - DNA, 635 bp, Homo sapiens
  misc_feature: GYAE6OF02FP0OZ.17.43.D10.1.454.CMB.1.raw
  modified_base (474)..(474): a, c, t, g, unknown or other
  misc_feature (474)..(474): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagcccaccctgtcttgtttctccgaggggaacagcccaccctctcctgcagggccagtcaggagtgtgagcaggactaacttagccttggtatcgagaccaagaaacctggaccaggcctcccgaggtcctcctcatcctagtgtgtccttccgaccgagggccctcgtggtctccagccagtctcgagggtctaggtcgggtccgtagggactaggtacgttactaccttcaccgtacctactcgacgccgtagcctgcgtagtctaggaagttactttcgacgttaagtttacgttacttgtacgngtaccttataacgtaagttaccgggttccggggacccccgggggttaggttacccggacgggtaaaccggtaacggaagggtaggtaaccggtactaaccggaacggttacgtcggttacgcgtacaccgtactcgttacgcgtacttccgtacctacccg

SEQ ID NO: 176474 - DNA, 578 bp, Homo sapiens
  misc_feature: GYAE6OF02GGZM4.17.43.D10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactggagaaatggtgatgacgcagtctccagccacctgtctgtttctccgaggggacngccaccctntcctgcagggccagtcagagtgtgagcagcaacttgcctggtatcagcagaacctggacctagggcctcccgaggctccctcacttctatcggtntccttccaccgcgggccncgtggtccgtccagccaggtctcggagggcagtcgggtcgngggacngtacgttcactcacgaccatcagcacgcctgcagtctagagttatttgattagtttacttacgttctgactactacgttataacgttaacgggtcccggggtaccccggggggtacgttacccgggaaccgaacgggacgaagggtggagtacgtacgaaacggtcggtaggtacggcgtacncgacctntccgtcgttccttctacttcccg

SEQ ID NO: 176475 - DNA, 571 bp, Homo sapiens
  misc_feature: GYAE6OF02GOGGK.17.43.D10.1.454.CMB.1.raw
  modified_base (252)..(252): a, c, t, g, unknown or other
  misc_feature (252)..(252): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtgtctccaggggaaagagccaccctctcctgcgagggccagtcagtagtgttggcagcaacttagcctggtancagcaagaaacctggaccaggcctcccgaggcctacctcatgtatggtgcatctaccgagggcccagtgggtccgtacccgagccgtaggtcagtggcgtaggtgggtcgtgggacagtacgtttctctcgtactgtcatcagccagcctgccagttcgtagtaagtgttttaggtacggtttttattgtcgtactagtactagttaattaatcgtacgttcggtccgttacggtcggtccgttacggaccgtaacgggacgtaaggtacggaaacgtaacgaacgtacgtggtaggctagccactactccgtgttacc

SEQ ID NO: 176476 - DNA, 721 bp, Homo sapiens
  misc_feature: GYAE6OF02F33F1.17.43.D10.1.454.CMB.1.raw
  modified_base (158)..(158): a, c, t, g, unknown or other
  misc_feature (158)..(158): n is a, c, g, or t
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgnagtctaccagccacctgtctgttcncgagggacgngccaccgtntcctgcgagggccagtcaggtagtgtgagcagctaacttagtccttanatcanacacgaacctggaccaggcctacccgaggtcctcctanacttagtacgttggtccgtaccgtcccgaacggtccggggccgtcgtacggtcgtaccccgcgtaccgtggtaagtccggaggggtcctagggttcggggagtcggggtaacaggtttacccgttacacctttcctaaccccaacgtacctacggaccggaccgtaccggtcctcggtacgtacggttacgtaagttaacgtttgtttacgtacgtttaaggttttaacttacgttacggttactaacgtcgttaaacttaagttaaacgggtaccgggttccgggggtaccccgggggttacggttccgggaaccgggtaaccgggacggtagggaacgggtagtaacgtaaccgtaacggtaagtacggttactcggaaccgtacgacgttacttagttccggtttacttcccgtaccgttccccg

SEQ ID NO: 176477 - DNA, 767 bp, Homo sapiens
  misc_feature: GYAE6OF02F2U00.17.43.D10.1.454.CMB.1.raw
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (288)..(288): a, c, t, g, unknown or other
  misc_feature (288)..(288): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttcncgagggacngccacctctctcgcacggccagtcagaggtgtgagcagctaacttagcctggtatcagcaacgaaaccgtggccaggcctcccaggtccttcctanttctagtcggtctccttccgaccggtacgggccgtcgttcgggttccgtaccccgaggcccctaaggtacgtttaccgggacggggtctaacgggttggggttacggtacggggacgaggttcggttacaccgtttcgtaccaacgtactcgacgcgacgtcctcggacgtacgtacgtagtaaaggtttactttacgtacgtttaacggttttaactaccgtttggtaccgtaacgtaccgtaactttaaacgttaaaccggttaccgggttaccccgggggtaacccccgggggggttaccgtttacccggggaaccggtaaacccggggtaaacccggtagggggttaaccgggtaaggtaccgttaaaccggtaaaccggtaaccggttacggggttacggtaccgttacgggtacccgtaacggttaccgttccggtttaaccgtttaccgtttacccgtaccgtttaccccgg

SEQ ID NO: 176478 - DNA, 768 bp, Homo sapiens
  misc_feature: GYAE6OF02GL3C3.17.43.D10.1.454.CMB.1.raw
  modified_base (185)..(185): a, c, t, g, unknown or other
  misc_feature (185)..(185): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttcnccaggggacagccaccctctcctgcagggccagtcagagtgtgagcagctaacttagcctggtatcgagcaacgaacctggaccaggcctcccgaggcctccctctatctagtcggtctccttacccgaaccggacgggtccgtcgttcgggtccgtccccgaacggcctaaggtacttccggacgggctaagggttcgggtcgtacggggactaaggtacgttacctaaccgttccgtaccgtaacccgtactaccgacggtaccgtaccggtcccgttgaccgtacggtccgttaagtaaacgtttacgttttacgacgtttaaacgttttacgtttacgttacgttacgtaacgtaccttaacttaaaacgttaaacggttaacccggggtacccgggggttaaccccgggggggttaacccgttacccggggtaaaccgggtaaaccggggtaaccggtaaaggggtacggtaacggtaaccgtaaccggtaaaaccgggtaacggttcgggttaacggaccgttacggaccgtaacgtacgttaccgttacgtttaccttacccgtacgtttcccccg

SEQ ID NO: 176479 - DNA, 796 bp, Homo sapiens
  misc_feature: GYAE6OF02H06P1.17.43.D10.1.454.CMB.1.raw
  modified_base (219)..(219): a, c, t, g, unknown or other
  misc_feature (219)..(219): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactacgtggagaaatggtagatgacgcacgtctccgacgccaccctgtcttgtttccacgaggggaacgacgcccaccctcgtccncgcgagggccagtcgagaggtcgtgagcgacgactaacgttacgccgtaggtactcgagaccgaacgtaaaccgtcgggaccggacggtccctaccgtacggtcccttaccgttactactaccgttaacggtcggttaccgtacccgtccgaaaccggtccgggccgtaccggttcggtaccgtaccgaccgtccgacggtaacgttaccgggacgggacgttacgggtcggttacggtacgggaacgtaggttaccgttccgaccgtaccgtaccgaccctacgttacgaacggccgtaccgtccggttacgacgtaacgtcgttaacggtaagttacgtttcggtaacgtttacgtttaacttcggttacgttcgtaaccgtacttaaacgttacgttaaccgggtaccgggttacccggggggtacccggttaacgggttacccgaccgggttaaaggggaaccccggttaagggaccgggttaagtaaccgacggtaaaccggtaacggttcggtacgtaccggtacggacctaaccgttgttcccgtacgttaccgttacctggttaccccg

SEQ ID NO: 176480 - DNA, 799 bp, Homo sapiens
  misc_feature: GYAE6OF02F6T59.17.43.D10.1.454.CMB.1.raw
  modified_base (185)..(185): a, c, t, g, unknown or other
  misc_feature (185)..(185): n is a, c, g, or t
  modified_base (407)..(407): a, c, t, g, unknown or other
  misc_feature (407)..(407): n is a, c, g, or t
tcagcgtagactagcacgaccggtgctcgatttagactagcagtaagggggaggaactgctcagttaggacccagacggaaccatggaagccccagcgcagcttctcttcctcctgctactctggctccagatactactggaagaaatggtgatgacgcgagtctccagccacctgtctgtttcnccgaggggacgcgcccaccctctcctggcgacgggccagtcgagagtgtagacgcaggactaacgttacgcctaggtactcacgacgaacgaacctggaccgaacggtcccctacccggacgggtcccttaccccgtactaacgttccgttaaggttggggttaccgttacccttaccccgaacccgggacggggtcccgtcgttacgggtcccgtacccgngaccgtacgtacgtaccggacggggtacgtaggggttcgggttccggaagggtacgtaagggttaccgttccgtaaccgtacccgtaccaaccgtacctacggacggtacccgaacggttcctacggaccgtttaacggttcccggttaaaaggtaaccggttttagttttaccgaacgttttttaaggtttaacctttcggtacgttacacgttaacctaagtttaaaccgttaacgggttacccggggtaccccgggggggtaacccggggtcggtacccggtaaacgggtaaccgggtacggaaacggttagggaacctaaccgtaacgtaacggcggttgaccggtcgaccgactcggtagttacgttccgttactaccgtctacccg

SEQ ID NO: 176481 - DNA, 1146 bp, Homo sapiens
  misc_feature: GYAE6OF02FX6KJ.17.43.D10.1.454.CMB.1.raw
  modified_base (227)..(227): a, c, t, g, unknown or other
  misc_feature (227)..(227): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccacctgtctgtttctccgagggacacgcccaccctctcctgcgacgggccaggtccagngtgtgagcagacctaacgttacggccgttaggtactccgaagacccgtaaagtaacccgtggacccgagggtcccctaccccggaggtccccttcccgttactacttaccgttaggtcgggttaccgtacccttcccccgaaaccggtccgggggtccccgttcggttaccgggttacccggtacccccgtacggtaccccgtaagggttaccggttttaacccggggacggggggtacccttaacgggggtttcggggttaaccgggttaacgggggaacccgttaaacggggtttaccgtttaccccgtaaccgtttaaccccgtttacccggaaacccgttaccgttaccgggaaccgttccccgggtaccgtaccccggttaacggtacccgttaacggggttaccgttaaaacgggtttaaaccgggttttaaccgtttttcgggaaacccggtttttttaaggttttttaaaccctacgggtttaacccgggtttacctaaacccggggtttaaccccttaaaagggttttaaaaccgtttaaaccccgggggtttaaccccggggggtttacccccccccgggggggggggggttaacccccccgggggggggttttaaccctttaaacccccggggggggaaaccccccgggggttaaaaaaaggggggtaaaccccccggggttttaaacggggggttaaacccggggtaaacccgggtttaacccccgggttaaaaccggggttaaaaaaccccggggtttcccgggggttttaaaccgggtcccccgggggttaaacccgtaacccgggttaacccctaaacccccggggttttcgttttttaacccgggtttaacccccgtttacccccgtttaccccgggtttaacctttttaccccccccccggg

SEQ ID NO: 176482 - DNA, 707 bp, Homo sapiens
  misc_feature: GYAE6OF02G9MAO.17.43.D10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagcgtagactagcacgaccggtgctcgatttagactagcagtaaggggaggaactgctcagttaggacccagacggaaccatggaagccccagcgcagcttctcttcctcctgctactctggctcccagatactactggagaaatggtgatgacgcagtctccagccaccctgtctgtttctccgaggggaacngccaccctctcctgcagggccagtcagagtgtgagcagcaacttcgcctggtactcagcaagaacctggccaggcctccgagcctccnatctagtggtctccttccgaccgcggggcctacgttgggtccgtccccgagtcccgagtacgttccgggaaggggctaggggttcggggtcgtagggggactaggtacgtttccaacttccaccgacctatcgaacggccacgcctggacctacgttctaggaagtttagtttttcggactttaaggtttttactttacgttgttacctaacgtacctaaacttaacgtaaaccgttacccggggttcccggggggtaccccccgggggggttacgtttacccggggaaccgggtaaaaccggggtcccgttaaaaggggtcgggtaacgaacgttacccggaaaagggttccggtacggtacgggtccgtacgacctaccgtactttccggttacggttaccctttaccgacgtttcccccg

SEQ ID NO: 176483 - DNA, 848 bp, Homo sapiens
  misc_feature: GYAE6OF02FUGE2.17.43.D10.1.454.CMB.1.raw
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccagatactactggagaaagttggtgatgacgcagttctccagccacctgtctgtttcncgagggacngccacctntcctgcgacgggtccacgtcagtacgtgtagagccagtcctaacgttacgccttaggtactacgaaggccaacgaaaacccgtggacccaagggtcctcccccgaggtctaccccgtcgattaccttacggtggtcgtccggtttcccaaccgggtacgggtccgtccgtttacgggttcccgttaccccgaggtaccgtaaacggttaccggttacgtacgggggacctaggggtttacggggtacgtttacggggaacgtaacggtacgtttaccgaccgttaccttaccgtaacccgtaacgttacgaaacggttccgtaaacggtcccgtttaacgaccgtacggttaccgtaaaggtaacgtttacgttttacgaacgttttaaggttttaacctacggtttcgtaaccgtaggtaacctttaaccgttaaacgttaaccggtttaaaccgggtcccggggggtaaccccggggggttaaccttaccgggggttaacccggaaaccgggttacggaaaccgggttacggggaacgttaaccgtaaacggtaaaccggttacggtacgggtacgggtacctacggaccctaaccggttcgtttacccggtactttacgttaccgtacccgttacccgg

SEQ ID NO: 176484 - DNA, 747 bp, Homo sapiens
  misc_feature: GYAE6OF02F5M1P.17.43.D10.1.454.CMB.1.raw
  modified_base (152)..(152): a, c, t, g, unknown or other
  misc_feature (152)..(152): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtnatgacgcagtctccagccacctgtctgtttcncgagggacngccacctctccgtgcacgggccagccgagagtgtgagcagacctaacgttcgtaccgtggtactacgagacgtaacgaaacccgtggaccccaaggcccgtacccgaggtcccttacctacgacttcgttaggttcgggtactcccgttacccgaccggtacgggtccgtctcgggtccctcccgacgtaccgacgtacgttcggaggtcgtacgggttacgggtccggtagggtaacggtacggttacgttaccctccgttacctacccttacacgtacgtacgaccgtacgtaccgttaggtaaccgtggttaacgtaagtttatttcggtaacgtttgtttaaactttcgacgttacaacgtacttaacctttaactaaaccgggttaccgggtcccggggggtaacccgggggttcgtaacccgggacggtaagggacccggtaagggtacggaagttcccgaagtaaccggtaccggttggtaccggtacggtacccgtaacgtccgtatttccgtccgtttaaccgtaccgtccgttacccctaaccg

SEQ ID NO: 176485 - DNA, 790 bp, Homo sapiens
  misc_feature: GYAE6OF02H3ALA.17.43.D10.1.454.CMB.1.raw
  modified_base (134)..(134): a, c, t, g, unknown or other
  misc_feature (134)..(134): n is a, c, g, or t
  modified_base (146)..(146): a, c, t, g, unknown or other
  misc_feature (146)..(146): n is a, c, g, or t
  modified_base (160)..(160): a, c, t, g, unknown or other
  misc_feature (160)..(160): n is a, c, g, or t
  modified_base (371)..(371): a, c, t, g, unknown or other
  misc_feature (371)..(371): n is a, c, g, or t
tcagcgtagactagcacgaccggtgctcgatttagactagcagtaagggggggaggaactgctcagttaggacccagacggaaccatggaagccccagcgcagcttctcttcctcctgctactctggctcccanatactactgganaaatggtgatgacncagtcctccagcccacccttgtacttcgtttcctccgaagggggaacgacgccctaccccgttctccgtcggccgtaggggcccaagttccgaggtagtgtggacgtcgagacctaacgttacgccgttagtactacgaggcctaacgaacccgtcggaccgtaacggccgtacccgtacggccttcctactactacttacggtccggttnttcccgtcccgtacggacggtcccgtcggtttacggtccgtacccgtagaccgtaacgtacgttcggaacggggtcttacgggggtcggttcggacgggtacgtaacgggtacggtttccgtaccgttacccgtcctaacccgtaacttaccggaacgtacccgacggtttcccgtacgggtaccttaacggttacggttaagttaaccgtttaggtttacggtaacgttttacgtttaacttacgtagttacgtctaactaaccgttaattaaaccggttccgggtacccgggtccccggggtaacggttcccggaccgggtaaccggtaacggtaccggtaggaacttaccgtaacgtaaccggtcgtacggtcggacgacctacgtactgtaccgttctaccgttctacgttcccc

SEQ ID NO: 176486 - DNA, 885 bp, Homo sapiens
  misc_feature: GYAE6OF02F8GBA.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggcctcccagtatactactggagaaatggtagatgacgcagtcctccagccacctgtcttgttcctacggaagggacgacgcccaccctcgtcgtcggaccgacgggccagtacgaggacggttgtcggagccgaacggtacctaaacgttacggccgtttagggtactacgagacaaacgtaaccgtcgggacctacggtccctaccggtacggtcctaccgtacactttaccgtaggttcggttcctacccgttaacccgaccgggtacggggtcctccggttcgggtacccgttaccccgacggtaccggtaaagttaccgtttacggggaagggtaccggttacggggttcggggttaccggtaggggaaaccctaggggttaactttccgtaacccgttccgtaacccctaccgtaacgttcgaacgggtacccgtaccggtacctcgtaaaccgtggttaacgttaacggtaaagttttctttacggaacgttttaacgttttattacggttccgacgttaaaccgagttttaaaccggttaactaaaccccgggtttaccggggggtccccggggggttaaacccccggggggtacgtttaacccgggggaaccggggaaaccggttaacggggttaacgggccgggtttaagaaccttaacccggggtaaacggttaactccgggggtaccgttacgccgtaacccgtacgttaagttttccgaccggttttcctacccgttaccttaccccgg

SEQ ID NO: 176487 - DNA, 785 bp, Homo sapiens
  misc_feature: GYAE6OF02JGVDD.17.43.D10.1.454.CMB.1.raw
tcagcgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgttctccgaggggaacacgccaccctctcctgcgagggcccagtcgtaggacgttgtggacgcaacggactaacttacggcctaggtactcagaccaacgaaacccgtggacccgacggtcctacccgtacggcctcctactactacgttagtcgggtcgtccttacccggaccggacgggtccgtcgttcggtccgccgaccgtccgtagtacgttacggacggggtcgtcggggttagggtcggtacgggacgtagggtacgttccgtaccgtccgtaccaacctcgtaccacggcctaccggtccctaaggtacccgttaggttaccttagggtaaacgtttagttttccggtaaacgttttagtttaacgtttacgtacggttactacggtacctaaagtttaaaccgttaaacggttacccgggggtaccccggggggggtaccccggggttaaccgggttaaccgggaacccgttaaacgggggaaccgtaaggggtccgaaacggtccgtaaaacgtacccgggtaggtaccgggttacgccgtaccggaaaccgtccgttacgttacgttccgtttaacgttcctaccccgttaaccg

SEQ ID NO: 176488 - DNA, 765 bp, Homo sapiens
  misc_feature: GYAE6OF02IMRHS.17.43.D10.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (752)..(752): a, c, t, g, unknown or other
  misc_feature (752)..(752): n is a, c, g, or t
tcagcgtagactagcacgaccggtgctcgatttagactagcagtaagggggaggaactgctcagttaggacccagacgaccatggaagcccagcgcagcttctcttcctcctgctactctggctcccagatacttacgtggagaaatggtgatgacgcacgtctccagcccacccgtgtcttgtttccncgaagggaacncgccacccttctcctgcgagggccagtcgaggtagtgtacgagcagtacctaacttgaccgttagtactacgaggaccaacgtaacccgtcggaccgacgtccctaccggacgtcctaccctactacgtcgttagtcgggtctcccgttaccaacgggtcgggtccgtagttacggtcccgtacccgaacgtaccgacgttacgtacgggacgggtactacggggtttacgggtacgtagggtaaccgaggtccgttttacaccggttaccttacaccgtacgtacgacgaacgtcgtacccggttagacgtacgttaggttacgtaaagtttcgtttaacggtaactttaggtttaacctttaacggcttaactaacgttccgaaattacccggtaaagttacccgggggttacccgggggacccggggttaaccgtacgggaaccgtaaacgggacggtaacggggtagtaaccggaactaacccgggtaagtcggttaacggcccggttagtaccgaacgtacccgtttcgttaccgtacgttcccttnttaacccgtcccg

SEQ ID NO: 176489 - DNA, 1003 bp, Homo sapiens
  misc_feature: GYAE6OF02GQYSK.17.43.D10.1.454.CMB.1.raw
tcagcgtagactagcacgaccggtgctcgatttagactagcagtaaggggaggaactgctcagttaggacccagacggaaccatggaagccccagcgcagcttctctcctcctgctactctggctcccagatactactggagaaatggtgaatgacgcagtctccgagcccacctgtcttgttctccgaggggtacacgcccaccctctccgtagccgagggccctaggtacacggtacggtggtacggacgtaccgagaccgttaacgttacgcccgttagggtacttaccggaacgaccgtaaacggtaacccgtagggaccccgaacggtcccgtaccccggaacgggttaccttccccgtaactaaccgttacccgttaagggtccgttacggtaccccgttaacccggtacccggaacggggttccccgtacgttccgggtaccgttaccccgacggtaccccgtaagggtacttaccggggacgggtcgtaacggggttcgggtacggtacgggtaacggtacggtaacgttaccgtaaccgttccgttaacccggaacctacggttaccgaacggtaccgtacccgggtcgttaacggtaccgtaacggttacgttaaccgggtaaggtttacggtttaccggtacgttttaacgggttttaacccgttacccggtttaggtaacccggttacttaacccgttaaacccggttaaacgtttaaacccggggttaaccccggttaccccgggggggggtaaccccgggggtttaccgggtttaacccggggaaacccgggggtttaacccggggaaacccgggttaaacggggttaaccggggtaaccggttaacccggttaacggggtaaaacccgggtacggtttaaccggggttaacccggttccgggtaaccggttaccccggttacccggttaaacgggtttccccgtttaacgggttaacccgtttaccggttacccgtttacccccccgg

SEQ ID NO: 176490 - DNA, 826 bp, Homo sapiens
  misc_feature: GYAE6OF02GEHAS.17.43.D10.1.454.CMB.1.raw
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (792)..(792): a, c, t, g, unknown or other
  misc_feature (792)..(792): n is a, c, g, or t
tcagcgtagactagcacgaccggtgctcgatttagactagcagtaagggggaggaactgctcagttaggacccagacggaaccatggaagccccagcgcagcttctcttctcctgctactctggctcccagatactactggagaaatggtgatgacgcagtctccagccacctgtctgttcncgagggacncgccacctctctgcgacggcagtcaggngtgtgacgcgacgactaactagcctaggtactcagacaacgaaccgtggaccgtacggcctacccggcgtacctaccgtactacgttacgtacggttccggtttaccgttaccccgaacccgggtccggggtccccgtttcggttaccgggttacccggtcccccgaaaggtccccgttaaacgggttacgtaccgggggtaacggggtaccttaaccggggggttcgggggttaacccggttgggacccggtttaaaggtccgtttaccgaccttacccgtaccgtaaacccgttcgtaccgtaacgcccgtacggttacctcggactacgggtacctaggttaaacgtttcgtttagaacccgtttaggttttaaccttgggacttacgtccgttaaactacgttaaacggttaaaccggttcccgggtacccgggggggtaacccccgggttataccgggtaaccgggaaccgggttctaaacgggttcggaaacttccggtaaaccctaaggggtaccgttcggggtagttacccggaccttacgttcggtttacccgtaccgggtttnttacccctttaaccgcccgttttaccccgtaccg

SEQ ID NO: 176491 - DNA, 695 bp, Homo sapiens
  misc_feature: GYAE6OF02GWGXW.17.43.D10.1.454.CMB.1.raw
  modified_base (142)..(142): a, c, t, g, unknown or other
  misc_feature (142)..(142): n is a, c, g, or t
  modified_base (181)..(181): a, c, t, g, unknown or other
  misc_feature (181)..(181): n is a, c, g, or t
  modified_base (205)..(205): a, c, t, g, unknown or other
  misc_feature (205)..(205): n is a, c, g, or t
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
tcagcgtagactagcacgaccggtgctcgatttagactagcagtaaggggaggaactgctcagttaggacccagacggaaccatggaagccccagcgcagcttctcttcctcctgctactctggctccagatactactgganaatggtgatgacgcagtctccagccacctgtctgtttcnccgaaggggacacgccctaccgtntcctgcgacggccagtcacgngtatcgagacagacttaacgttcgccgtaggtactaccaaggtccaaacgtaacctggaccacggtcctacccgngtacctctacatcgagttcggtntccctacgacgcgcgtcgtcgtcgactgaccgtagtacgcggcgtacggcggttaggcgtacggtnacggttctatactctacccgnaaccgtgaaccgctacgtcgtcgtacgtattccggaagttacgttacgttactacgtttcgttacgtttacgttccacgtagtaaccttaagaacggttaacggtccgggttacccggggtccggggttaaccgtaacccgggttaccgaaccgggtaaaggtccgggtaacgggaacggttaaccgtaaagggtaccccgttaaggggtacccggtacggtaccgttacgtaccgtacttccggtttaacggtccgtccgtttttacggaccctttaccccgg

SEQ ID NO: 176492 - DNA, 868 bp, Homo sapiens
  misc_feature: GYAE6OF02JWVK9.17.43.D10.1.454.CMB.1.raw
  modified_base (219)..(219): a, c, t, g, unknown or other
  misc_feature (219)..(219): n is a, c, g, or t
tcagcgtagactagcacgaccggtgctcgatttagactagcagtaagggggaggaactgctcagttaggacccagacggaaccatggaaaagccccagcgcagcttctcttccctcctgctactctggcctcccagatactactggagtaaatggtgatcgacgcacgtcctccagaccctacccgttgttcgttcgttttcacccggaggggaaccgngcccctaacccttcgtaccgtgccgacgggcctagtacaaggtacggtgtcggacgaccacggtacacgttacggtccgtagggttaccacgacggaaccgtaacggtaacccgtggaccccgtacgggtaccgtaccccggacggttccctaccgtacctacgttacgtacggttcggtacctccgttaacccgtaccggaccggggtccgtccgtcggttctacccggaaccgttaccgtacggtacggtttaccggaacgggtcggtaacgggttcgggttaacccgagggttacccgtaaggtacgttaccccgtacttcccgtaacggtaccctgtaacccgcggtacttccgacgtcggtacgttacggtacgtaaggttacgttagtttaccggtaacttagtttaacccttacgtacgtacgtacgtaccttaaacgttaaacgttacgttaccccggggtacccgggggttacccgggtaaccggtaccggggtaaaccttaacggggaacgttacgggaaccgtaggtaaacccgtaaccgttaacggggaaccccggttggaaccggtacccgtaacggtccgaaaccctttcggtaacccgtttacgttacccggttaccctacgttaaccccccgg

SEQ ID NO: 176493 - DNA, 866 bp, Homo sapiens
  misc_feature: GYAE6OF02IYEJA.17.43.D10.1.454.CMB.1.raw
  modified_base (138)..(138): a, c, t, g, unknown or other
  misc_feature (138)..(138): n is a, c, g, or t
  modified_base (142)..(142): a, c, t, g, unknown or other
  misc_feature (142)..(142): n is a, c, g, or t
  modified_base (202)..(202): a, c, t, g, unknown or other
  misc_feature (202)..(202): n is a, c, g, or t
tcagcgtagactagcacgaccggtgctcgatttagactagcagtaaggggaggaactgctcagttaggacccagacggaaccatggaagccccagcgcagcttctcttcctcctgctactctggctccagatactacngganaaatggtgatgacgctagtctccacgccaccttgtaccttgtttcctacgaggggaaccncgcccacccgtctccgtggacgtacgggcctagtcaacggtagtcggtcgaaggccaacggtacccgttaaacgttcgcccgttagggtacttaccgacgaccaacgggtaaaccttcggaccgtacggtacccctacccggacggtccttcccgatacgtacgtaggtcggtctccgtaccgaccggtcggtccgacgttcggtccgtccgacgacgtcggtaacggttccggacggtcgtacggtgggtaccggtagggacgtacgggttaaccgttccgaaccgttccctaacccggtaagtacctaccggtaacgtaccggtacccgtacggtttacgaccgttacggttacggttaaccgtttaggttacgtttaacggacgttttaaccgtttaagtttaccgttacggttaagacccgtttaactaacgtttaaaccggttaaccgttaacccgggggttacccggggggtaaccccgggggtttaaccggttacccggggaaaccggttaaaccgggaccgggttaacgggttacgggaaccgttaacggtaacccggtaaccggttaaccggttacggggcgttaacccgtacggtaacccgtaccggttaaccttccggtttaaccttaccggtttacccgtccgtttaccccg

SEQ ID NO: 176494 - DNA, 670 bp, Homo sapiens
  misc_feature: GYAE6OF02F4GQT.17.43.D10.1.454.CMB.1.raw
  modified_base (145)..(145): a, c, t, g, unknown or other
  misc_feature (145)..(145): n is a, c, g, or t
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
tcagcgtagactagcacgaccggtgctcgatttagactagcagtaaggggggaggaactgctcagttaggacccagacggaaccatggaagccccagcgcagcttctcttcctcctgctactctggctcccagatactactgganaaatggtgatgacgcagtctccagcccacctgtctagttcnccaaggggtaacncgcccacctctcctagccagggtccagtacagagtgtgancagtccaaactgcctaggtatcagcacaaccgtgccagctaccaggcaccgtcatctaggtgtcgtcctaccgaccgaggggcctctcggtacgtacccacgtaccaggtactaggtacgggactgggtcggtccgtaggtaacagagttcctaacgtcttccgaacgactacgacgtaccaacgtcctgaactacgttactacggtaaagttagtttcccatttaacggtttactttacttagtcgaacgtactaaccgttaattaaacgtaaaccgggttcccggggacccccggggggttaacgttacccggggaacccgtaaaggggaaccgtaaagggttacggaacgtacgtaaccgtaaacgaacggttacggtcggaccgtacgaacgtaccgacttgttaccgtactacgtaccgttacccg

SEQ ID NO: 176495 - DNA, 486 bp, Homo sapiens
  misc_feature: GYAE6OF01AFYHS.44.9.A09.1.454.CMB.1.raw
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttgacaccaccaccagcttcttagcctggtaccagcagaagcctggccaggctcccaggctcctcatatacgatgcatccagcaaggccgctggcatcccagacaggttcagtggcagtgggtctgggacagacttcactctcagcatcagcggactggacgcctggagattcngctagtttatctgtcagcagtatggttgtcacctntgacgttcgccaagggaccaggtgaatcaaacgactgtagactgcncntcg

SEQ ID NO: 176496 - DNA, 487 bp, Homo sapiens
  misc_feature: GYAE6OF01C5Q79.44.9.A09.1.454.CMB.1.raw
  modified_base (194)..(194): a, c, t, g, unknown or other
  misc_feature (194)..(194): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
tcagacagtatatacacgaccggtgctcgatttagcgagacgcgcaggggagagctgctcagttaggacccagagggaaccatggaaaccccagcgcagcttctcttcctcctactactctggctcccagataccaccggagaaattgtgttgacgcagtctccaggcaccctgtctttgtctccaggggaaanagccaccctctcctgcagggccagtcagagtgttgacaccaccaccagcttctagcctggtaccagcagaagcctggccaggctcccaggctcctcatatacgatgcatccagcaaggccgctggcatcccagacaggttcagtggcagtgggtctgggacagacttcactcncagcatcagcggactggagctgagattcgngcagtttattactgtcagcagtatgggttgctactntgacgttcggaccaagggccaaggtgaaatcgaaacgatgtgactgcacntctg

SEQ ID NO: 176497 - DNA, 590 bp, Homo sapiens
  misc_feature: GYAE6OF01DF4QK.44.9.A09.1.454.CMB.1.raw
  modified_base (247)..(247): a, c, t, g, unknown or other
  misc_feature (247)..(247): n is a, c, g, or t
tcagacagtatatacacgaccggtgctcgatttagcgagacgcgcagggggagaggctggctcccacgtttagggtaccccaggagggtaaccatggtaagccccagcgcagcttctcttcctcctgctactctggctcccagtacgaccactggagaaagttagtgatgacgtacagtctccagccaccctgtctctgtctccgaggggaaagaggccaccctcgtcctgccaggggccagtcagngtgttggcagcagcgtagccttggttcccagctaagtaaacctggccagacctcccgaggcctcctcagtcctactaccgacactccaaccagggcctactggtactcccagccaagtacttcaagtggctacgtgggtctgggactagtacgttcgactccgtacactatccagctacgcctgctaagttctaggaactattttcgcttagttttactttactgtacagctagttatagtgtactcggtccttcgttctaccgtttcggcccttagggaccctacggtagttcggtatttaccgaaaacggttacttgggttacgcgttacgccgaccgtag

SEQ ID NO: 176498 - DNA, 539 bp, Homo sapiens
  misc_feature: GYAE6OF01D3VEK.44.9.A09.1.454.CMB.1.raw
  modified_base (194)..(194): a, c, t, g, unknown or other
  misc_feature (194)..(194): n is a, c, g, or t
  modified_base (314)..(314): a, c, t, g, unknown or other
  misc_feature (314)..(314): n is a, c, g, or t
  modified_base (388)..(388): a, c, t, g, unknown or other
  misc_feature (388)..(388): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttgacaccaccaccagcttctagcctggtaccagcagaagcctggccaggctcccaggctcctcatatacgatgcatccagcaaggccnctggcatcccagacaggttcagtggcaggtgggtctggggacagacttcactctcagcatcagcggactgggancctggaggtattctgactagtttattactgtcagtcagtagtggttcgtctaccgtcgtggaccgtttcgggacctaaaggggtaccctaaagggtacggaaaacttcgaaaaccgtactaggtacgacgttaggaccctaacgtattccg

SEQ ID NO: 176499 - DNA, 616 bp, Homo sapiens
  misc_feature: GYAE6OF01EKLJJ.44.9.A09.1.454.CMB.1.raw
  modified_base (193)..(193): a, c, t, g, unknown or other
  misc_feature (193)..(193): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtgttgacaccaccaccagcttcttagcctggtaccagcagagacctggccagccctcccaggcctcctcatccacggtgcactccaacgacgggccacgtcggccgtccccgtgacgaggttcaggtggcgaggtgggtctgggacagacttcgactctcaccatcagcacgccgtggacgccgtagtaagtagttttgtagtagttgttacttacttcgtctactttcctagttccggttaccctttacccgttaccgttaaccgttttcggaccgtaacggggtaaccctaaacgttacggtaaactaccgaaaaccgtaacgttacggttaggtacgtcgacctaaccctacgttccgttacgttacctttcctacttcccgttaccccg

SEQ ID NO: 176500 - DNA, 685 bp, Homo sapiens
  misc_feature: GYAE6OF01DF6DE.44.9.A09.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtcctccaggccaccctgttctttgtctccgaggggaancgcccaccctctcctgcagggccagtcagngtgtgacaccacacagtcttctagcctggtaccagcagaacgcctggccaggcctccgagcctcctacatactacgatcgacactaccagacaacggcccgacgtcggacctactaccccgaaggtaccgtaggttaccgaaggttcgggacgtaagggttcggggtacgttacgggggaacctacgggtaccctttaccgtaccttccgtacgaaccgacctacgttaccggaacggtacccgggtacggttacgggaccggtcccggttaagggacggttacgtttcgttacggtacgtttacggtttttaacgttacgttggtaccgtaagtacgttaaggttgttcgggtttcggtaccttaccgttcgtacggttaccggttacggaccgtaaacgggactaggtaggtaacgtaaacgtacaaacgtacgtcgtacgactacgctacgtacg

SEQ ID NO: 176501 - DNA, 648 bp, Homo sapiens
  misc_feature: GYAE6OF01BW7Z1.44.9.A09.1.454.CMB.1.raw
  modified_base (197)..(197): a, c, t, g, unknown or other
  misc_feature (197)..(197): n is a, c, g, or t
tcagacagtatatacacgaccggtgctcgatttagcgagacgcgcagggggagagctgctcagttaggacccagagggaaccatggaaaccccagcgcagcttctcttcctcctgctactctggctcccagataccaccggagaaatagtgatgacgcggtctccagccacctgtctgtcgtctccgaaggggaaancgccacctctcctgcacgggccagtcagagtgtagcacgctaacttcgcctcgtaccagcaagaaactcgtacggccgacggcctaccgaggcctccgtcaatctagtggtcactactcccgacgacgggccacgtgtacctccgagccgtaggttcaggtcggcgtagggtcgggtcgtagggaactaggtacgttccgtactaccgtaccaacgtactccgaagtccacgtccctgaccgttacgtcgtaagtaaagttcgttttcgaacgttttaaggttttacttacgttacgtacgtaagtacgtaagtttaataacgtcggttaacgtcccggtacccttacccggtacggaaccggaacgggtacctaaccggtagtaacggtaacgtaaacgttaacggacgttggaccggtcagtactacctagtccttcgtacttcgtacc

SEQ ID NO: 176502 - DNA, 521 bp, Homo sapiens
  misc_feature: GYAE6OF01EA0NY.44.9.A09.1.454.CMB.1.raw
  modified_base (482)..(482): a, c, t, g, unknown or other
  misc_feature (482)..(482): n is a, c, g, or t
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactggggcctgagtggggtggacaatcaccgccacgccgaacaacagaggcgcacatcagtttcagggcagagtctacctttcgtggacaagtccacgggcacgagtatacatagaatctcaactgacctgcgtatttgcgacgaccgcgtatattagtgtgcgagaagagtcctgcctacaaaggtnacgagctagactccgacccgtgggccagggaccctcggg

SEQ ID NO: 176503 - DNA, 567 bp, Homo sapiens
  misc_feature: GYAE6OF01BARQH.44.9.A09.1.454.CMB.1.raw
  modified_base (196)..(196): a, c, t, g, unknown or other
  misc_feature (196)..(196): n is a, c, g, or t
  modified_base (417)..(417): a, c, t, g, unknown or other
  misc_feature (417)..(417): n is a, c, g, or t
tcagacagtatatacacgaccggtgctcgatttagcgagacgcgcagggggagagctgctcagttaggacccagagggaaccatggaaaccccagcgcagcttctcttcctcctgctactctggctcccagataccaccggagaaattgtgatgacgcggtctccagccaccctgtctgtgtctccgaggggaaancgccaccctctcctgcagggccagtcagagtgttagcagctaacttagcctcgtaccagcaagaatcgtggccaggcctccgaggcctcctcactctactaccacactccaaccgacgggcctacgtggtactcccgagccaagtacttcgaggtcgctacgtgggtcgtgggacagtacgtcactctacacatcagcacgctgctagtctagtaacgttntttgacttagtttactacgtcgtacagtactaagttatacgtcgtaccgtcggtccctccgttacggaccgtaacggccacggtacgtgaaacgtaacgttaaacgagtcggtcgcgtacgacctactacgttctcgttccttcgtaccg

SEQ ID NO: 176504 - DNA, 689 bp, Homo sapiens
  misc_feature: GYAE6OF01AWSJ0.44.9.A09.1.454.CMB.1.raw
  modified_base (192)..(192): a, c, t, g, unknown or other
  misc_feature (192)..(192): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccagccacctgtctttgtctccgagggganagacgcccaccctctcctgcgagggccagtcaggagttgtaccagctaacttcgcctaggtaccacgacgaaacctgggaccaggcctcccgagcctccncatctancggaactctccacgacgggccctagtggtaccaccccgaccgtggtttacaggtcggaccgtacgggtcggggtacccggaatacggtaacgtttccgaccttacgtacccaacctaagtccgaacgggtcccggtaccgttcgaccgtaggttaccgtggtacgggtttacttttcggacgtttaagttttacttacgtgtaccgtaggtacgtaagttaacgtaaatacggttacgtcgtttactccgttacgggttccgggacggggtaacccgaggggttacgacgtacgtaagtaaccgtaggtacggtcggtactacgaccgtacgttagtaccgttcgttacttaccttaccttccgttccccgattaccgttgtcgttaacg

SEQ ID NO: 176505 - DNA, 613 bp, Homo sapiens
  misc_feature: GYAE6OF01CY5RU.44.9.A09.1.454.CMB.1.raw
  modified_base (194)..(194): a, c, t, g, unknown or other
  misc_feature (194)..(194): n is a, c, g, or t
  modified_base (321)..(321): a, c, t, g, unknown or other
  misc_feature (321)..(321): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcacctgtctttgtctccgaggggaaanacgcccaccctctcctgcagggccagtcagagtgttgacaccaccaccagcttctggcctggtaccagcagaagcctggccaggcctcccgaggcctcctcatactacgatgcatccagcaaggccncgtggcactcccaagacgtaggttcaggtcggactaggttcgggtctaggggacaggtaccttcactcgtcagcatcgagcggactggacgtccgtaggaggtattcgtgtcttaagttttacttacgttgttacaagtcgttaaggttacgttgggtttacgtacctaccgttcgttcggtaaccggtttccgggaaacccgtaacggggaaccgtaaaggggttaaggtaaaccttacgaaaacggtaacgttaggtaccggtaacgtacgaaccctaacgtcttaccgg

SEQ ID NO: 176506 - DNA, 754 bp, Homo sapiens
  misc_feature: GYAE6OF01DDGNV.44.9.A09.1.454.CMB.1.raw
  modified_base (199)..(199): a, c, t, g, unknown or other
  misc_feature (199)..(199): n is a, c, g, or t
  modified_base (745)..(745): a, c, t, g, unknown or other
  misc_feature (745)..(745): n is a, c, g, or t
tcagacagtatatacacgaccggtgctcgatttagcgagacgcgcaggggagagctgctcagttaggacccagagggaaccatggaaaccccagcgcagcttctcttcctcctgctactctggcctcccagataccactggaagaaatagtgatgacgcagtctccagcccaccctgtctgtgtctaccgaggggaaancgcccaccctctccgtgcgacgggccagtcagagttcgtaccagtacctaacttacggcctaggtaacccaaccgaacgaaaccgtgggaccacggcccttacccgaggtcctacccgtctagttaccgttaagtacggaaactactaccccgaaccggacgggccctacgttacggtacccttcccccgaacccggtagggtttccaacgggtcgggtaccgtaggggttccggggtacccggaacgtaaggttaccggtttaccaccttccgtacctaacctacgtccgacggcccggtcctggaccgtaaggttccgtagggtaagtttagttttcgaaccgttttaagttttacgttacgtcgttacacggttactaaagtactttaaacgtaccgtcggtaccctttacgttaccggtttaacccgggttaccgggggaccggggttaacagggttcgaagtacgtaacgtaaacggtacgttggtcgaccgtagaccgtaacttcgtgttccgttacttaccctagttccccttacccgngttacttcg

SEQ ID NO: 176507 - DNA, 704 bp, Homo sapiens
  misc_feature: GYAE6OF01AZ8YJ.44.9.A09.1.454.CMB.1.raw
  modified_base (201)..(201): a, c, t, g, unknown or other
  misc_feature (201)..(201): n is a, c, g, or t
tcagacagtatatacacgaccggtgctcgattttagcgagacgcgcagggggtaggagctgactcagttaggacccagagggaaccatcggaaaccccagcgcagcttctcttcctcctgctactctcggctcccagattaccaccgggagaaattgtgttgacgcagtctccaggccacctgtctttgctccaggggaangccacctctctagcacgggccagtcagagtgttcgacaccaccaccagcttcttagccttggtaccagcagaacgtcctggccaggcctacccgacggtctcctacactaactacgatcggctacgtaccgagccgaaacggcccgtacgttcggacctaactaccccgaaaggtaccgtacggtttaccaagggttcgggacgtaagggttcggggttacgttacgggggaaccacggttaacctttaccgaacccgttacgttaacgaagtaccgtacgttacgaggtaccgggacgttacgggacgtaccgtaggacgggtactttacgtagtacgttaacgtttacttacgtcggtactacggtacttaagttagttcgggttcgtaccgtacgttcgttacggttaccgttaccggtaaccgtaaccgggtaccgtaacggtaacggtaaactaccgaaacgtacgtacgtacgtacgtacgtactaccgtacttccg

SEQ ID NO: 176508 - DNA, 526 bp, Homo sapiens
  misc_feature: GYAE6OF01B2E1R.44.9.A09.1.454.CMB.1.raw
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggtggacatcaaccgcacgccggaacaacagaggtcgcacatcagtttcagggcagagtcaccgttttccgtggacaagtccacgggcgcagtatacatgaatctacaatgacctgcgatttgcgacacggaccgtatattactgtgcgagaaagngtcctgacctacgaaagtcgacngctggctccgaccccgtgggcccagggacccgtaccggg

SEQ ID NO: 176509 - DNA, 564 bp, Homo sapiens
  misc_feature: GYAE6OF01AHJED.44.9.A09.1.454.CMB.1.raw
  modified_base (386)..(386): a, c, t, g, unknown or other
  misc_feature (386)..(386): n is a, c, g, or t
  modified_base (519)..(519): a, c, t, g, unknown or other
  misc_feature (519)..(519): n is a, c, g, or t
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccgcaggcctctcggactgggcctgagtgggtggacagtcaaccgccacgaccggaacaacagacggtcgcacatcgagtttcgagggcagacgtctaccgtttccgngacaacgtccgacgggtcgcgtagtactacgatacgaattcacgaatcgacctgcgtatttcgcggtacacggtcgtaatcttacgtggtcgacggtaagaaacgtgtcctagaccgtaacgaaacgtcgacngctacggcctcccggacccgtcggggaccctacgggacccgtcgg

SEQ ID NO: 176510 - DNA, 621 bp, Homo sapiens
  misc_feature: GYAE6OF01EKM0U.44.9.A09.1.454.CMB.1.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (405)..(405): a, c, t, g, unknown or other
  misc_feature (405)..(405): n is a, c, g, or t
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcagctacgaggtgtccactcccaggtccagctggtgcaatctgggcctgaggtgaagaggccgtgggtcctgggtgaggtctcgtgtaaggtcctccggancgagtgtgttcgtnagacatacactcaccgtgggtccgcacggcctcgtcggaacgtcgggcctggaggtgggtcggaacagtccgaaccgccgacgaccggaacacgaggacggtcacacacgtcgagtttcgaggcagtacgtcctaccgtttacgnggaacgtaacgtccgacgggctaccaggtacacagtacgaacgtcacgtaatcgacgtagacgttagttcgaccggtaacgtccggtacgttaatacgttacgtggtacgacggtaagaaacggtcgtaccgtacgacccgtaaggtaaacgtccgacgtcgacgttcgacccgttccggaccccggttcgggaccccagggtaccccgtaccggg

SEQ ID NO: 176511 - DNA, 766 bp, Homo sapiens
  misc_feature: GYAE6OF01DN2FN.44.9.A09.1.454.CMB.1.raw
  modified_base (203)..(203): a, c, t, g, unknown or other
  misc_feature (203)..(203): n is a, c, g, or t
  modified_base (748)..(748): a, c, t, g, unknown or other
  misc_feature (748)..(748): n is a, c, g, or t
tcagacagtatatacacgaccggtgctcgatttagcgagacgcgcagggggagagctgctcagttaggacccagagggaaccatggaaaccccagcgcagcttctccttcctcctgctactctggcctccagactaccgacggagtaaattgtgttgacgcagtcctcgaggccacccttgttctttgtctaccgaagggaancgccctaccctctccgtgcgacgggcctagtacgagtagttgttacgaccaacccaccacctagtccttaccgttagccgtaggtacccagaccgaacggaaccgtccgtacgggtacccgacgggtaccccttacccccggaggtaccccttaccctaacggtaacttaaccgttaccggtaattaccgacctaccgttacccgaacggaccggtaaccgggcccgtcgttacggacctaacctacccgaacggtacgttacggtacgtagggtcgacgtagggtacggttcggacggtaacctacggtaccttcaacgtccgtacgacgactagccgaacggtcggtacgcggaactcggtaggtagtccttggacgttaacttacgttttaactcgtacgtacgtagtaacgttagggttaccggttgttaccggtaccttaccggttaccggttaaggtacccggttaacgggaaccggaaacggttaacggtaaagggtaacggaaaacgttaccgaaagttcgaacgttacgaccgtanaccttaacgttcgttacg

SEQ ID NO: 176512 - DNA, 808 bp, Homo sapiens
  misc_feature: GYAE6OF01EWHIW.44.9.A09.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtcctccgaggccacccttgttctttagtcctccgaaggggaaancgccaccctctccgtgcgaggccagtcagagtgtgaaccacccaaccncgtacgtctttactacgcccgttaggtacccagacgaacggaacgcccgtaggccgacggccctaccccgaacggtacccttcccgtactattccgttaatacgtaacctttaccgttaccgtaacgggttacgggtcccttgttcgggaccaccgttcccccgacgtccccgtacgttacgacggtcgggaccgttaggttcggggtacgtacggggaccacggttttaccgtccctaacgttccctacgtaacccctataccccgaaccgtacgttaacctacggaacctcccgtagtaaacttttcgtttacgtaactttacgttttagttaccgtcgttaaacccgtacgttaaacgtaacggtaacggttcccgaaccttaaccgtaactttactttacccgttacggttacccggtacccgttaaacgggtaacccgttaaaggtaccgggttaaattaaaccggtaaaccgttaaaaccgggtcgtttacgggcggttaacccctagtaaccccgtacgttaacgttccctttacggtccttttaacccg

SEQ ID NO: 176513 - DNA, 705 bp, Homo sapiens
  misc_feature: GYAE6OF01CR15Y.44.9.A09.1.454.CMB.1.raw
tcagacagtatatacacgaccggtgctcgatttagcgagacgcgcagggggagagctgctcagttaggacccagagggaaccatggaaaccccagcgcagcttctcttcctcctgctactctggcctcccagactaccgaccggagaaatttgtgttgacgcagtctccgaggccacccttgttctttcgtctccggaaggggaaagcgcccacccttctctgcgacgggccagtcagagttgtcgaccacccaccaccagtccttactacgtccgtacggtaccagacaaggtacgtcgtcggaccacggcctacccgaggtcctcctactatacgtacgatcgacactccgagcgaacggccgcgtcgacctacgaccgacgacgtacggttcgaacggtcggtagtacgggtacgggtcgtacggggactacgtaccttctacgtcacgacgtctagacgcggtacgggacttacgggacgtaccgtaggtacgtacgttacgtagttcgttagtttttaacgtacgttacggttacgtacggtagttaggtttcgttacgggttacgttcccaccggtttcgtacccggttaccggtaaccgggtaccggaacgggtaaccggtaaacgggtaacggtaaaccggttaaaccgaaacggttacgtaccggtacctacgttaccacccgtacttacgttacg

SEQ ID NO: 176514 - DNA, 737 bp, Homo sapiens
  misc_feature: GYAE6OF01CPX9S.44.9.A09.1.454.CMB.1.raw
  modified_base (200)..(200): a, c, t, g, unknown or other
  misc_feature (200)..(200): n is a, c, g, or t
  modified_base (453)..(453): a, c, t, g, unknown or other
  misc_feature (453)..(453): n is a, c, g, or t
  modified_base (487)..(487): a, c, t, g, unknown or other
  misc_feature (487)..(487): n is a, c, g, or t
  modified_base (724)..(724): a, c, t, g, unknown or other
  misc_feature (724)..(724): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccacgtggaagaaatagtgatgacgcagtcctcacgccaccctgtctgtgtctaccgaggggaaacncgccaccctctcctgcgacggccagtcagagttcgttaaccagactaacgttacgccgtacggtaaccaaccgaacgtaaaccgtgggacgaacggccttacccgacggtcctcccgtactatacctaagtacggaacctaccgtcccgaaccggacggtaccctacgtacggtaacctacccccgaaccgtacggttccgacggttcggacgtacggtcggggtaccggaacgtagtacgtcacgtcacacntacgagtccgcgtacgcgtacgtcgtggtagttnttcgatttacgtttacttacgtgttaccgagtacgttaaagtacttaaacgttacgtccggtccttaccgttaaccggtttacccggggttaccgggggaaccgggggttaacggtaaggggttcgtaaacgacgtttaaccggaaaacggttacgttagggttacgcgttccggtacccgtaaccgttcgttcgttacccgtttcgtttaaccctactttccccgttaacccggtnttaaccggttacg

SEQ ID NO: 176515 - DNA, 761 bp, Homo sapiens
  misc_feature: GYAE6OF01AFLNI.44.9.A09.1.454.CMB.1.raw
  modified_base (160)..(160): a, c, t, g, unknown or other
  misc_feature (160)..(160): n is a, c, g, or t
tcagacagtatatacacgaccggtgctcgatttagcgagacgcgcaggggagagctgctcagttaggacccagagggaaccatggaaaccccagcgcagcttctcttcctcctgctactctggcctcccagactaccaccggagaaattgtgttgaccgnagtcctccaggcctacccttgttcctttacgtcctaccggaagggggaaacgacgcccctaccctcctaccgtcgcggacgggccagtacgaggtaggttcgttagacccacccacccacctacgtctttaccgttacgccgttacggtacccgaggacgaacggaccgtccgtccgggaccgacggtaccctccccggacggttccccttccgttacaacgtttaccggtaacgtacgtcggtaccacgttacccgacggtaaccggaccgggtcccggcgtacggacccgtaccaccccggtaagtaccgtacgggttacgagggtcgggcgtaacggggttcgggtcggtacggggactacgtccgtaccacttcgacgcgtactcgtacggacggaccgggtacgacgggtccgttccgtagggtaccggttgtttacccgtggttacgtttacgtttacgtcgttacgtactaggttacgttagttacgggtttcgtccgttacgtccgttcgaccgggttccggtacggaccggtacggaacggtacggtaagaacgtacgaaccgtagtcggtactacgcgactactcggtacg

SEQ ID NO: 176516 - DNA, 1089 bp, Homo sapiens
  misc_feature: GYAE6OF01DF8CJ.44.9.A09.1.454.CMB.1.raw
tcagacagtatatacacgaccggtgctcgatttagcgagacgcgcaggggagagctgctcagttaggacccagagggaaccatggaaaccccagcgcagcttctcttcctcctcgctactctcggcctcccagataccgaccggagtaaattcgtgttcgacgctacgtcctccgacggccacccttgttcgttttcggttaccgtacccggaaaggggggaaacgtaccgaccccaccccgttccgttcccgtacggaccggaccggggtacccaacgttaccggaaggtacggtttcggttacgaacccgtaaccccaaacccacccgtacggttccttttaccgtttaccggtcccgttaaccgggttaacccaggaaccgtaacggaaccggtccggttaccgggacccggtaacggtaccccgttaccccggaacggtcccctttacccccgttactaacgtttaaacctaaccggtaacgttaccggaaccctaacgttaccccgggaacggaccggtaaaacccgggcccggtaccggtccggtaacctaacccgtaccccgaaaccgtcgggttaacggttaccggaaggggttccgggaacgggtaacgggttcggggggttaccgttaacggggggtaccaaaccggttaccgtttacccgacgtttacccgtagtaaccgtaaccctaaccggttacgggaaccccgggtaccggggtaacccggttaggggaacccggttaccgggttacgggttaaggttacccggttttaaccgggttaccgtttaacgggtttaaccgttttaacgttaccggttacgttaacgggtaaccggtaaggtttaacgggtttacgggttttacgggtttaccccggttaaccgttaccccgggtttacggttaacccgggtttaaccccgggggtacccggggtaaacccgggtaaaccgggggtaaaccgggttaaacggggtaaacccgggttaaaaacgtaaaccccgggtaaaacccgggtttagtaccgggttaacccggtttaacgaacccgggtaccctacgggttacctttaacccgg

SEQ ID NO: 176517 - DNA, 926 bp, Homo sapiens
  misc_feature: GYAE6OF01EV0ER.44.9.A09.1.454.CMB.1.raw
  modified_base (207)..(207): a, c, t, g, unknown or other
  misc_feature (207)..(207): n is a, c, g, or t
tcagacagtatatacacgaccggtgctcgatttagcgagacgcgcaggggagagctgctcagttaggacccagagggaaccatggaaaccccagcgcagcttctcttcctcctgcctactctgctcccagactacccaccggagtaaattgtgttgacgctagtcctcgacggcacccttgttctttagtcctaccgaggggaaacncgaccctacccttcctccgtgccacggggccctaaggtccaaggtagttacgttcggaaccctacccaacccaccgtaacggtccttttaccgtttacggcccgttcggtaacccgaagaccgaaacggtaaccgcccgtacggacccgaacggcccgttaacccccgtaaccgggtccttacccgtttactaacgtttaacgtaaccccgttagtccggtaacctaaccgtccccgaacggaccggtaaaacgggcccccgttacggttaccggaccgttaccgaaccccgagtaacccggtttaggtttaccgaagggttcggacgtaacgggttcgggttacgtacgggaaacctacggttccttaaccgcccttacggtacccgtcccgtttacaacccggtactaacgttaccggttaacgaaccggttacgttaggttaaacgttacgttttttacgtaccttttaaagttttacttaaccgggtttacttacccggtaggttaccttacccggggtttcccgttacccccgttaccgggtacccgggttaccttaccccgttaccgggtttaacccggggtttaccggggggaccggggaaacccggttaaggggaccggttaaggaacccggttacgaaacggttaccgggacggtttacggaccggttaccgttaccggaacccttcgtttaaccgttgtttaaccccgg

SEQ ID NO: 176518 - DNA, 731 bp, Homo sapiens
  misc_feature: GYAE6OF01BQX3C.44.9.A09.1.454.CMB.1.raw
  modified_base (132)..(132): a, c, t, g, unknown or other
  misc_feature (132)..(132): n is a, c, g, or t
  modified_base (137)..(137): a, c, t, g, unknown or other
  misc_feature (137)..(137): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
tcagacagtatatacacgaccggtgctcgatttagcgagacgcgcaggggaccacataacaaccagattcttcctcttaagaagcccctgggagcacagctcatcaccatggactggacctggaggttcctntttgnggtggcagcagctacaggtctccactccaggtccagctggtgcaatcgtgggcctgaggtgaagnggcctgggtcctggtgaggtctcgtggtaacgtccncggaanctagtcgtgtcgtnagacatacactcaccgtcgggtccgcgacggcctcgtaggtaacgtcggggccttaggagggttgggggtacggtaaacaacgtaccgaacccgccgaaccggaccggtaaaccaacgacggacggtcgacctaacgacgttacgtacggtttcggaagggcaacgtacgttacccgttaccgttttccgggaacggtaaccgtaacggtacccggaacgggtaccggacgtaacggtaactaacgtaagtcgtaaactctacgtaagtacctaccgttgtacgtacgttttcgggaaccggtaccgaccgggttacgtaacgttacgttacgtcggtacgacggtaagaaaccggttacgttcccgtacgtaacccgttaaacgtaaacgttaccgacgtacgtaccgtacggacccggttaccccgggaccccgggtacccggtaacccgggcccgttcccggtaccccgg

SEQ ID NO: 176519 - DNA, 990 bp, Homo sapiens
  misc_feature: GYAE6OF01AP0ST.44.9.A09.1.454.CMB.1.raw
  modified_base (205)..(205): a, c, t, g, unknown or other
  misc_feature (205)..(205): n is a, c, g, or t
tcagacagtatatacacgaccggtgctcgatttagcgagacgcgcaggggagagctgctcagttaggacccagagggaaccatggaaaccccagcgcagcttcctcttcctcctgctactctcggctcccagactacccaccggagaaattgtgttgacgcagtcctccgaggcaccctgttcctttgtcctccgaaggggaaancgtcccaacccttcgttacccgtgcgtacggggcctagttacgaagtacgttgttacgaacctaacccaacccaccgtaacggttcctttaccgtttaaccggacccgttttacgggtaaacccctaaggtaaccgtaaaccggtaaacggtttacccgttcggggaacccccggtaacggggtcccctacccccgggttaaaccggggtacccctttacccccgttaacgtaaaaccgttttaaccgttaacccgggttaaagtccggttaaacccttaacttaacccggaaaccgggtaaccccaaacgggggtaccccctacgggttaccggtaaccgtaaccccgttaacccccgaaaaggtaacccgggtttacggtttaacccggtaagggggttaacccggaaggtttaaaccggggttcggggtttaccggtaacggggggtaaaaccctaaacccggggttttaaaccctaacccgggttaacccggtttaacccgtaaccggtaccggtaaccggtaaacccgtttaaccgggaaaccgggtacccgggggtttaacgtaacggggtaacccgtacccgggtttaagggtaaccgggttaaccgtttcgttaaccgtacggtttaacttttacgttacgttacgtacgtacgtaacgttacggttagtaccggtttccgtaccgtccttacgtcgaccgttacggaccggtaacggaacgtaaggaagtaacaacgtaacgtagtacggtaactagaccgtaccgtctacgtacg

SEQ ID NO: 176520 - DNA, 618 bp, Homo sapiens
  misc_feature: GYAE6OF02IBY0D.44.9.A09.1.454.CMB.1.raw
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
tcagacagtatatacacgaccggtgctcgatttagcgagacgcgcagggggagagctgctcagttaggacccagagggaaccatggaaaccccagcgcagcttctcttcctcctgctactctggctcccagataccaccggagaaattgtgttgacacaatctccagccaccctgtctttgtctccgggggaacagccacctctcttgcagggccgccagactgttgacgacgacttagcctggtaccaacagagcctggccaggctcccagactcctnatctatgatacttntaggtagggccttctggcatccccagccccgnttcagtggcaggtgggtctgggacngtacttcactctcaccatccaccagtcctagacgcctaggaagttattttcgacttaagttttaactttacttcggttacctaaccgtaaccgttaaaggtaaggttcggtacccttacctaaattactttcctaccgttttccggacccgttacgggaacctaaacggtggtaattaactaacgaaaacgtacgtgtacggtacgttcgacctaacctacttcgttacgttccttctaccttccgttaccccgcctaccttctaacg

SEQ ID NO: 176521 - DNA, 556 bp, Homo sapiens
  misc_feature: GYAE6OF02FWRH8.44.9.A09.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttgacaccaccacagtcttcttagccctggtaccagcagaacgcctggccaggcctcccaggctcctnatatacgatgcatccagcaaggccnctggcatccagacgaggttcagtggctaggtcggtctgggacagtacttcactctacagcatcacgcagcctgctgtctagtaagttacgttttgacgttaagttttacttacgttgtacgagtctaagttaataagttcgtactcggtcccttcccgttcgaccgtaacgggactaacggtacgtacggaacgtaacgttaacggtacgttacggtacgtacgtcgacctacgtacg

SEQ ID NO: 176522 - DNA, 623 bp, Homo sapiens
  misc_feature: GYAE6OF02GJB35.44.9.A09.1.454.CMB.1.raw
  modified_base (195)..(195): a, c, t, g, unknown or other
  misc_feature (195)..(195): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (614)..(614): a, c, t, g, unknown or other
  misc_feature (614)..(614): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttgacaccaccaccagcttctagcctggtaccagcagaagcctggccaggctccaggctccncatanacgatgcatccagcaacggccgctggcactcccagaccgtaggttcaggtcggactaggtcggggtactggggacagtaccttcgacctctacgagctagtcaggcggtacgtgggaccgtccgtaggacggtactttcgtaggtaccgttaaggttttacttaccgtaggtactaacggtacttaggttacgttggggtttaccgttacctaccgttaccgttggttaaccgggtttccggacccggtaaggggaccgtaaagggtaacggtaaacttaacgaaaacggtacggttcggcggtacgtacggaccgtaccngtttacccg

SEQ ID NO: 176523 - DNA, 609 bp, Homo sapiens
  misc_feature: GYAE6OF02GLLUJ.44.9.A09.1.454.CMB.1.raw
tcagacagtatatacacgaccggtgctcgatttagcgagacgcgcaggggagagctgctcagttaggacccagagggaaccatggaaaccccagcgcagcttctcttcctctgctactctggctcccagataccaccggagaaattgtgttgacgcagtctccgaggccaccctgtctttgtctccgaaggggaaagagcccaccctctcctgcgagggccagtcagagtgttgaccaccaccaccagtccttctacgcctgtaccagcagaacgcctggccaggcctcccgaggtcctcctcatacgtacgatcgctactccagacgaacggccgctcggacactcccgagaccaggttcaggtcggacgtaggtcgggtcgtggggactagtaccttcacctctacgacgctataccgaggcggacgtgggacgtccgtaggtaggtacttcgtgtacgttagtttacttacgtcgtacagtacgtaggttagtgggtttcgtacctaccgttcgtaggtccgttacggaccgtaacgggtaaccgtaagggtaacggaaactaaccgaaaacgtacgtcggtacgtacgtacgactaccagttccg

SEQ ID NO: 176524 - DNA, 802 bp, Homo sapiens
  misc_feature: GYAE6OF02JVUST.44.9.A09.1.454.CMB.1.raw
  modified_base (199)..(199): a, c, t, g, unknown or other
  misc_feature (199)..(199): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccactggagaaatagtgatgacgcggtctcagccacccgtgtctgtcgtcctcgagggggaaacgngccacccgtctcctcggccgagggccaagtcgaaggtagtgttaacgcaagccaacgtttacgcctacgtaccagcaagtaatcgagaccgacggtacctacccgaggcctacccgtcactctaacgtaccaactactcccgaacccacgggtaccctaccggtaacgggtacctacccccgaggacccgaacggttacttccgaggttcggactacggttcgggtcacggggtacacgtcgttacacctcgtaccaccgtactacgacggtaccgtcctaacgtccgtagttaccgtagggtacgttagttttaccggtacgtttaacggtttacttaaccgtttggtaacctaacggttacctaagggtttaaaccgtttaaacgttaaaccggttacccgggttttaccctaaccggtttacccgttaaaccgggtttttcccggggggtaaacccggggggtactaaacgggggttacccgggttaagtaaccgggttaacccgtaaaacgggtaaacgtttcggtaacccgggttaggtaacccgtacgtaaccccgttaggttaccgtttacggttacccgtttacggttaaccccg

SEQ ID NO: 176525 - DNA, 581 bp, Homo sapiens
  misc_feature: GYAE6OF02F73VG.44.9.A09.1.454.CMB.1.raw
  modified_base (296)..(296): a, c, t, g, unknown or other
  misc_feature (296)..(296): n is a, c, g, or t
tcagacagtatatacacgaccggtgctcgatttagcgagacgcgcagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgttgacaccaccaccagcttcttagcctggtaccagcagaacgcctggccacggcctcccaggcctccncatactacgatgcatccagcaacggccgctggcactccccagacctaggttcaggtggcaggtgggtcgtagggacagtaccgttcacttcgtcgacgctactcgacggcggagtcgggacgtccgtggaacggtatttcgtggtacttaagtttacttaacgtgtacagtacgtagtagtttggttcggtcctaccttggtcgtacggttcggaccgaacgggtacgtaagggtagtaaacgtacgtaaacgtaccgttagtacgtacgtgacctacagttccg

SEQ ID NO: 176526 - DNA, 652 bp, Homo sapiens
  misc_feature: GYAE6OF02GAPRB.44.9.A09.1.454.CMB.1.raw
  modified_base (203)..(203): a, c, t, g, unknown or other
  misc_feature (203)..(203): n is a, c, g, or t
  modified_base (535)..(535): a, c, t, g, unknown or other
  misc_feature (535)..(535): n is a, c, g, or t
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcagctacaggtgtccactcccaggtccagctggtgcaatcgtgggcctgaggtgaagnggccttgggtcctcgggtgagggtctccgtaggtaaggtcgtccggaagctaggtcgtgttcgtcagacgatacactcaccgtgggtccggcaggcctcgtggaacgtgggacctgaggtggggtagggaacaatcgaaccgccgaccgaccggacaaccaggacggtcgcacgatacgtacgtttcgagggacacgtacgtacctacccgttttccggacgggtactaacggtcccgaacggggtccgtacaggttaacacgtagttacgaaatccacgaactcgacctgtcgagtttcgacggtaccgacggtaccgtagtacgttacgngttcgagaagtaacgacgttccgtgcctaacgaacggttaccgacggtaacggtaccgttaggacccgttacccggtaccccggtccggggacccggtaccgggtaccccgtaccgg

SEQ ID NO: 176527 - DNA, 655 bp, Homo sapiens
  misc_feature: GYAE6OF02H8057.44.9.A09.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgctcgagggaangccaccctntcctgcagggccagtcagagtgttgaccaccaccaccagtccttacttagcctaggtacccaggctaaggaacgcgtaggccaggcctccaggtcctcctnatacacgatcgntacnccagtacgaaggtcccgncggcacgtcccaggacctaggtttcacggtggacgtagggtcggtacgtcgggaactacggtcttccgatccgatacggactacgtaccgtagggaccggtacgttagggaccgccgttagggtacggtaacttccggtagtacgttacgttttttaacacgttaggacttaggtactagttacggttcggtacggttactacccgtgttaccgtacggttccgtacccgaacgggtaacgtaacggggtaacggaactacccggaaaacgttacggttacggtaccgtaacggtacgtaacccgtaccgtagtttaccg

SEQ ID NO: 176528 - DNA, 691 bp, Homo sapiens
  misc_feature: GYAE6OF02G0VFK.44.9.A09.1.454.CMB.1.raw
  modified_base (110)..(110): a, c, t, g, unknown or other
  misc_feature (110)..(110): n is a, c, g, or t
  modified_base (191)..(191): a, c, t, g, unknown or other
  misc_feature (191)..(191): n is a, c, g, or t
tcagacagtatatacacgaccggtgctcgatttagcgagacgcgcaggggagagctgctcagttaggacccagagggaaccatggaaaccccagcgcagcttctcttccncctgctactctggctcccagataccaccggagaaattgtgttgacgcagtctcaggcacctgtctttgctccgagggaaangccaccctctcctgcgagggccagtcagagttgtcgaccaccaccaccagtccttacgtacgccgttaccggtacaggcctagaacgtccgtggacctaggcctacccgaggtcctcctacgtaatacgtaacgactcggacaatccgagacgaacggccgtcgtacggacctaaccgtccgaacgtaccggtaggttacgaacgggtcggactagggttcgggtacgttacggggaaactacgtacctcgtaaccttccgtacgacgtacacgtcgacggtacggtacgtggacgtaccgtaggaacgtacttacgtcgtaacgttagtttaactacgtgtacgcgtacgtagttacggttagggttccgtacgtacccgttcgtacggtaccggttaccggtacccggtaagggtaaccggtaaacgggttaacgaaaccgtaacctaaacggtacgttcggtacggtccgtaaccggtactaacccgtgttacccgg

SEQ ID NO: 176529 - DNA, 629 bp, Homo sapiens
  misc_feature: GYAE6OF02HMP49.44.9.A09.1.454.CMB.1.raw
  modified_base (206)..(206): a, c, t, g, unknown or other
  misc_feature (206)..(206): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
tcagacagtatatacacgaccggtgctcgatttagcgagacgcgcaggggaccacataacaaccagattcttcctcttaagaagcccctgggagcacagctcatcaccatggactggaccgtggaggttcctctttgtggtggcagcagctacaggtcgtccactcccaggtccagctggtacgacaatcgtggctgaggtgaagnggccgtagggtcctggtggacggttctaccgttaggtaacggtcctaccgggtaagcgtaggttcgttagttcgtacgtacggaactacgtacacttaccgaccgtacggggttccggacgtacggcccgtagtacggaaccgttcgggaccgttaggaggtacgggtcggtaacggaacggaacggaccgaccaaggtaccgaacgacgacggancgcacagcgagttcganagacagtcgacgtccgaggacaacgtnacggnactagtacaacgagtanagtacganacgagtactnacgtacgtacgtacgacgaacgtacgtatacgtagtacgacaacgacgtagacgtactacgtacgtacgtaacgtacgagacgtacgaccgtacgtaccggaccgtacgacgacgtacgaacg

SEQ ID NO: 176530 - DNA, 875 bp, Homo sapiens
  misc_feature: GYAE6OF02H7BGS.44.9.A09.1.454.CMB.1.raw
  modified_base (196)..(196): a, c, t, g, unknown or other
  misc_feature (196)..(196): n is a, c, g, or t
tcagacagtatatacacgaccggtgctcgatttagcgagacgcgcaggggagagctgctcagttaggacccagagggaaccatggaaaccccagcgcagcttctcttcctcctgctactctggctcccagactaccaccggagaaattgtgttgacgcagtctccaggcaccctgtcttgtctccgaaggggaaancgccaccctctcctgcgacgggccagtcagtagttcgttaccagactaacttacgcctacggtaccaaccgaacgtaaaccgtgggacacgggcctcccgaggtccttccgtactactacctagtacgggaaaccactaccccgtaaccggacggggtaccctaacggttcgggtaaccctccccccgaacccggttagggtttaccgacgggtcgggtaccgtacgggggttaccgggggtaccggtaactaacggtacgtttaccgaaccgttccgtaccaaacccgtagtaccgaccgggtcccgggtactcgggtaacctcgggtttaccgttaagggttaggttttaaccgttttttacggaccgtttttaaggtttttaaacgttaccggttggtaacccgtaagggttaccgttaaaggtttaaccggttacgggtttaacggtacccgggttaccgtttccccggtttaccggtttaacccgtttaccccgggttttcccggggtaacccggttcggggtaaacccccttaacggttacggtttaacccgttaacgtttaaaccgaaacccgggttaagttccgggtacggttccgtaacgcccgttaaccttagttccgttacgttacctttaccgaccgtttccccgttacccgacttacgtacttacg

SEQ ID NO: 176531 - DNA, 715 bp, Homo sapiens
  misc_feature: GYAE6OF02GBIAJ.44.9.A09.1.454.CMB.1.raw
tcagacagtatatacacgaccggtgctcgatttagcgagacgcgcaggggaccacataacaaccagattcttcctcttaagaagcccctgggagcacagctcatcaccatggactggacctggagttcctctttgtggtggcagcagctacaggtgtccactcccaggtccagctggtgctaatcgtgggcctgaggtgaagaggccgtgggtcctcgggtgagggtcctccgtggtaacggcttcgtggaggcctaccgttctcagctatgtccttttagttgggtcgcgacgcggtcccctaggacgaaggtccttaggacggtaggccgtaggggaggtacgtcgacgttccccgtagttcgtttggtcgaccgtagtaccgtaagttacgactacgtagtaacgtttcgaaggtacgagtaacgtacctaaccgtacgttaacccggacggtaacgtaaacgttacccgaacggaaccgttaacgaaccgtacccgtaaactagtacgggaaccgtcgttaaggaaccgacgtacggaccgttaagacggttaactacgacggtaaacgaccgtaccgggacctagttaccgttaacgtttcgtagtaccgacggtacgtaccggtacccgtacgttaaccgttaacgtttccgaacctttacccgtccttccgttaaccgtaccgtacccgtacccgtaaccgtaaccgg

SEQ ID NO: 176532 - DNA, 697 bp, Homo sapiens
  misc_feature: GYAE6OF02FM76F.44.9.A09.1.454.CMB.1.raw
tcagacagtatatacacgaccggtgctcgatttagcgagacgcgcaggggagagctgctcagttaggacccagagggaaccatggaaaccccagctcagcttctcttcctcctgctactctggctcccagataccgaccggggaaattgtgttgacacagtctccaggcaccctgtctttgtctccgaggggagagagcccaccctctccgtggtacgggccaggtcggagtgttgctaacgtacctagcctggtaaccaacacgaaacctggaccaggcctccccgaggtcctccctacacgttccttaactacccaactaccttaccccgaaccgtacggggccccaacgttaggtaccctccccgaggacccagtactttacgaggttcggcctacgtggggtcgtaggggacctaggtacgtttccactcctaccaccgtatcgacgcacgccctgccacgtccgtggtacgtacttcgtacgttacttacttactacgaacctaaactaactttacttttacctttttacgttaccgttacgttacggttttcgaccggtaacgggtaaccgtaacggtcgttaggaacgtacgtaacgtaaacggacgttagtcggactcgtaccgtaacctacgttccgttcgttaccttactaccttacccgttacccgtaccttacttaccgtataac

SEQ ID NO: 176533 - DNA, 759 bp, Homo sapiens
  misc_feature: GYAE6OF02I9S8Y.44.9.A09.1.454.CMB.1.raw
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcaactacaggtgtccagtcccaggtgcagctggtgcagtctggggctggaggtgaagaagccgtggtcctggtgaaggtctccgtgcgaacggtcttcgtggacggctaccttcgttcacgtcttaagttcgttctttttagtttggggtgtaccgaccgtacggtcccccgttagggaacgtaaacggggtcttaggtaagggttgggtccggttagggggaacggggtacttccgtaaccgttaccccgttaagtttccggttttagggggtcgtcgtaagttaccggtaaatttaccggacgaaccgtaagttaacgtttacgaaggtaactaaggtaacgttaccgaaccgttaccgtaaccgggcgggtaaaccgtaaaccgttaccccgaaacggtaacggtaaccgaacgggtaccctaacgtagttaaccgggacgtccgttacggaaggcctaaagggtccgtaggacgttaccgtagttaaccggaaacgtaccgaccggactaagttcctttaagtccgtagttccgacggtacggaccgttccccgttgtaaccttatttaacgactaccgtttccctataccgtacctacgtcccctaacg

SEQ ID NO: 176534 - DNA, 811 bp, Homo sapiens
  misc_feature: GYAE6OF02G7VOI.44.9.A09.1.454.CMB.1.raw
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (384)..(384): a, c, t, g, unknown or other
  misc_feature (384)..(384): n is a, c, g, or t
tcagacagtatatacacgaccggtgctcgatttagcgagacgcgcaggggagagctgctcagttggacccaggagggaaccagtacggaaaccccagcgcagcttctcttcctctgctactctggctcccagactaccgaccggagtaaattgtagtgacgacagtcctaccgacggcacctgttctttntcctacgagggaanacgcctaccctctctgcgacggcagtcagtgtgtgaaccaccaaccagtactcgttctaggcctaggtaccagtcagaacaccgtggaccaggaccctccacggaccttccactactctaagtcgtaacttaccgttacgttacggtacggtcctcggttacggactaccccggttaccncccggcccgttacttccgagggttaccggacgtcggttacggggtcgtaacggggacttaacggtaacccgttaccgttaccgtaaccctccgtaaaccgtacttaccccggaaaccgttaccgtaacccggttaaccggaaccgggtaaccggggttaaaccgttttacggttacgttaaccgtttaagttttaccgtttaaccgttaccgttaaaccgtaccgtaacgggtttaacgaccggtaaccgttaccggggtaaccttaaggggttaaccggttaccggtttaccgggtaccggaaaccggggtaccgtaaacggtacgtaccggtacggtaaccgtaccggaaaacggttaccgtacggtaccgggaccttaccggacttaacccgaactttccgtacttaccggttacccttaccgg

SEQ ID NO: 176535 - DNA, 747 bp, Homo sapiens
  misc_feature: GYAE6OF02G4OVD.44.9.A09.1.454.CMB.1.raw
  modified_base (199)..(199): a, c, t, g, unknown or other
  misc_feature (199)..(199): n is a, c, g, or t
  modified_base (714)..(714): a, c, t, g, unknown or other
  misc_feature (714)..(714): n is a, c, g, or t
tcagacagtatatacacgaccggtgctcgatttagcgagacgcgcaggggagagctgctcagttaggacccagagggaaccatggaaaccccagcgcagcttctcttcctctgctactctggctccagataccaccggagtaaattgtgttgacgctagtctcaggcctaccctgttctttgtcctccgaaggggaaanacgccctaccctctccgtgccacgggcccagtccaagtacgttgttgaccaccgtaaccaaccagtctttacgtagtccgttacggtaaccagacgtacgaaacgtcccgtaggacccgtaacggcccttaccccggacgggtaccctccgtaacgtacgtaacgtaccgtacgttgaaccgtactaccgagaccgtaacggcccgtagtacggtacctaccgtaccgaagtacggtaccgttcggaacggtcggtctaacggggttcgggtacgtaggggaaccgttagtaaccgtttccgacctttccgacgacgtacccgttagtacccggtaaacggaccgggttaacgtcgggttacgacccggttaggtaccggttagtttacctaggtacttaagtttttaactcgttactacggacgtgttagtacgtttcgtccgtacgtccgtacttcgggtccgtaaccggtacggtaaaggaccgtaaaggtacgtaaaccacgtaaacggtntacgggttacaacgtcgaacctgtaacgttccg

SEQ ID NO: 176536 - DNA, 711 bp, Homo sapiens
  misc_feature: GYAE6OF02HWHH7.44.9.A09.1.454.CMB.1.raw
tcagacagtatatacacgaccggtgctcgatttagcgagacgcgcaggggaccacataacaaccagattcttcctcttaagaagcccctgggagcacagctcatcaccatggactggacctggaggttcctctttgtggtggcagcagctacaggtgtccagtcccaggtgcgtctggtgcaatctggggctgaaatgaagaagcctgggtcctcggtgaaggtctcctgcacggcttcgtggaggcatcttcagaactatcttatcacctgggtgcgacacggcccctggacaagggtcttggaggtggagtggggtggtccgtccgtaccccttaagtttcggaactaagacctaaaacgtaccgctaacaagtaaacttaccgacgggtacaacgactaccgaacgtacgttacccggacgggaaccgaacgtaccgaacggagttcgacgacgtacctaagttaacgtcgggtaacgtctacggtccgtacctaaccgtacggtaacgacgtaccgtaggaccgggaaccgtaacccggtacccgttaagtttacgttttacccgtcggtacgtaccgggaaacgtaaaccttaaaaaccgttttacccgttaacccgtttaacgggttttttacggggacggttaaggttcggtaattcggttacttagttacggttaagtttagggtttaccgggtaaacccggg

SEQ ID NO: 176537 - DNA, 704 bp, Homo sapiens
  misc_feature: GYAE6OF02F28JR.44.9.A09.1.454.CMB.1.raw
  modified_base (196)..(196): a, c, t, g, unknown or other
  misc_feature (196)..(196): n is a, c, g, or t
  modified_base (696)..(696): a, c, t, g, unknown or other
  misc_feature (696)..(696): n is a, c, g, or t
tcagacagtatatacacgaccggtgctcgatttagcgagacgcgcaggggagagctgctcagttaggacccagacggaaccatggaagccccagcgcagcttctcttcctccgtgctactctggctcccagataccactggagaaatagtgatgacgcggtctccagccaccctgtctgtgtctcgaaggggaaanacgaccaccctctccgtgcgacgggccagtcagtagttgtagcgagacaacttacgcctacgtaaccagacaaaggaacttacgtcggacctaacggcctacccgagccctaccgtactactcgtagtcggtcgactacgtcccgaacgacggtacctacgttacggtacctacccgtagaccggtaaggttccgaaggttcgggacgtaacgggttgggtaccgtacgggaacggtacgtacgttaccaccgttcctaaccgaactactacgacgtacgacgtcgtcgacgttacgttaccgttagtaacgttagtttacgtacgtttagttttacttaagttcgttacgacgtacgtaagttaattacgtacgttaccgtacggtacccttcccggttacggtaaccggaacgtaccgtacgaaccggtaaggtaacgttaaaccgttaaacgtacgtacgttacggtacgtaacggtacccttaactcgtttaccgngtttaacc

SEQ ID NO: 176538 - DNA, 828 bp, Homo sapiens
  misc_feature: GYAE6OF02IGY3C.44.9.A09.1.454.CMB.1.raw
  modified_base (817)..(817): a, c, t, g, unknown or other
  misc_feature (817)..(817): n is a, c, g, or t
tcagacagtatatacacgaccggtgctcgatttagcgagacgcgcaggggagagctgctcagttaggacccagagggaaccataggaaccccagcgcagcttctcttcctctgctactctggctccagataccaccggagtaaattgtgttgacgtcagtctccgacggctaccctgttctttcgtcctaccgaagggaagacgtcctaccctctacctgccgacgggcctaaaaacgtctaggacgttggttacgaccctacccgaaccctaccgtaacgtcctttaccgttacggccgtaacggtaccctaacggaccgtaagtaaacggtccccgtggacccaacggggtcccttacccgacggtaccttcccgtacgtactaacgtaaccggtacttacgggacctaccgtaccgaacggaccgtaaacgggccccgtaacggttcggtaacccctacgttaacccccgaggtaccgttaagggttaccgaagggtaccgggtcgtaacgggtttacggggtccgttaagggggaacccttaacggtaacccgtttactaccgttacccgtacgtaaccggtactaacggttccgaaacgggtaccgggttacgtagggaaccgttacccggttaggtaaccggttaacgtttcgtaggttaccttaagttttacgtaccgtaggtacgtaaccgtagttaacgtaacttaaacgggttcacgttacctacgttacgttaaccggttcggggacggttaaccgtagggtacgtagacgttaacgaacgtaggttccgacggtccaggtacccncgtagttcccg

SEQ ID NO: 176539 - DNA, 745 bp, Homo sapiens
  misc_feature: GYAE6OF02GH2FU.44.9.A09.1.454.CMB.1.raw
  modified_base (565)..(565): a, c, t, g, unknown or other
  misc_feature (565)..(565): n is a, c, g, or t
tcagacagtatatacacgaccggtgctcgatttagcgagacgcgcaggggagagctgctcagttaggacccagagggaaccatggaaaccccagcgcagcttctcttcctcctgctactctggcctcccagtacttccgaccggcgtaattgtgttgacacaatctccacgccaccctgttctttcggtccgtacccgggggaacgacgacctacccttcgtcttgaccgacggggcccgaccgacgtacttggttacgaaccggacctacgttacgtccgtacggtaaccaactaacggacgcccgtaggaccctacggcccttacccgaacgacccttaccgtctaccttacgttaattcgtaactttaccgttacgtaggttaccgggcccttaccgtacggacctacctacccgtacgtccccgttcgtcgtaacggtcggcttaggttccgggttcgacggactacggtacctcaaccttcgtaccctaaccgtctaacccgaactacgaccgttaagccgtaccgtacgtaagttacttcgtattacgtttattacgtnttaccgtaacgtaccgtaagtaacgtcgtacctaccgtaattacctaccggtccgttacgaccggttagaaacgtaacggtacgtaagttaccaacgtaaactcgtaacgtcggtacacgtactacctaacgtcctcgttaccttacggtccttaccgtcccgtacctacgttacgtacc

SEQ ID NO: 176540 - DNA, 383 bp, Homo sapiens
  misc_feature: GYAE6OF01EFQLK.23.6.A06.1.454.CMB.1.raw
  modified_base (377)..(383): a, c, t, g, unknown or other
  misc_feature (377)..(383): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgctagtttacttctgtcagcagcgttccgccacgcccgctcactttcggcggggggaccagggtggagatgagacgaactgtggctgcaccatctgtcttcatctccgccatctgaatactcgcgtctgagcgggctggcaaggcgcatagnnnnnnn

SEQ ID NO: 176541 - DNA, 276 bp, Homo sapiens
  misc_feature: GYAE6OF01ET4RG.23.6.A06.1.454.CMB.1.raw
  modified_base (274)..(276): a, c, t, g, unknown or other
  misc_feature (274)..(276): n is a, c, g, or t
tcagacgcgagtatcacgaccggtgctcgatttagatctactgacagggggacatctatgagtctggttcgtagtgtaatcaactactactacctcatggacgtctggggcaaagggacctcggtcaccgtctcctcagcttccaccaagggcccatcggtcttccccctggcgccctgctccaggagcacctctgggggcacagcggccctgggctgcctggtcaaggactacttccatactcgcgtctgagcgggctggcaaggcgcatagnnn

SEQ ID NO: 176542 - DNA, 385 bp, Homo sapiens
  misc_feature: GYAE6OF01D2GX3.23.6.A06.1.454.CMB.1.raw
  modified_base (326)..(326): a, c, t, g, unknown or other
  misc_feature (326)..(326): n is a, c, g, or t
  modified_base (378)..(385): a, c, t, g, unknown or other
  misc_feature (378)..(385): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgctagtttacttctgtcagcagcgttccgccacgcccgctcactttcggcggggggaccaggggtggagatgagacgaactgtggctgcacatctgtcttnatcttcccgcatctgaatactcgcgtctgagcgggctggcaaggcgcatagnnnnnnnn

SEQ ID NO: 176543 - DNA, 380 bp, Homo sapiens
  misc_feature: GYAE6OF01EC7FW.23.6.A06.1.454.CMB.1.raw
  modified_base (376)..(380): a, c, t, g, unknown or other
  misc_feature (376)..(380): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgtagtttacttctgtcagcagcgttccgccacgccgctcactttcggcggggggaccagggtggagatgagacgaactgtggctgcaccatctgtcttcatcttcccgcatctgaatactcgcgtctgagcgggctggcaaggcgcatagnnnnn

SEQ ID NO: 176544 - DNA, 381 bp, Homo sapiens
  misc_feature: GYAE6OF01CHVWF.23.6.A06.1.454.CMB.1.raw
  modified_base (376)..(381): a, c, t, g, unknown or other
  misc_feature (376)..(381): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcggggggaccagggtggagatgagacgaactgtggctgcaccatctgtcttcatcttcccgcatctgaatactcgcgtctgagcgggctggcaaggcgcatagnnnnnn

SEQ ID NO: 176545 - DNA, 429 bp, Homo sapiens
  misc_feature: GYAE6OF01BBUGJ.23.6.A06.1.454.CMB.1.raw
  modified_base (214)..(214): a, c, t, g, unknown or other
  misc_feature (214)..(214): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (380)..(381): a, c, t, g, unknown or other
  misc_feature (380)..(381): n is a, c, g, or t
  modified_base (383)..(383): a, c, t, g, unknown or other
  misc_feature (383)..(383): n is a, c, g, or t
  modified_base (385)..(386): a, c, t, g, unknown or other
  misc_feature (385)..(386): n is a, c, g, or t
  modified_base (389)..(390): a, c, t, g, unknown or other
  misc_feature (389)..(390): n is a, c, g, or t
  modified_base (393)..(393): a, c, t, g, unknown or other
  misc_feature (393)..(393): n is a, c, g, or t
  modified_base (395)..(396): a, c, t, g, unknown or other
  misc_feature (395)..(396): n is a, c, g, or t
  modified_base (398)..(429): a, c, t, g, unknown or other
  misc_feature (398)..(429): n is a, c, g, or t
tcagacgcgagtatcacgaccggtgctcgatttagatctactgacagggccgagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggancctgatggattttgcagtttacttctgtcagcagcgttccgccacgccgctcactttcggcggggggaccaggggtggagatgagacgaactggtggctgcaccatctgtcttcatcctccgcatctgaatactcgctctgagcgggntggcaacgggcncatagnnangnntcnngtntnncnnnnnnnnnnnnnnnnnnnnnnnnnnnnnnnn

SEQ ID NO: 176546 - DNA, 407 bp, Homo sapiens
  misc_feature: GYAE6OF01CQR7L.23.6.A06.1.454.CMB.1.raw
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (393)..(407): a, c, t, g, unknown or other
  misc_feature (393)..(407): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcaggtgggtctgggacagagttcactctcaccgtcagcagcctggagcctgatgtattttgctagtttacttctgtcagcagcgttccgcacgccgctcacgtttcgggcgggggaccnggggtggagatgagacgaactgnggctgcaccatctgtacttcactccttcccgctatctagaactacgtcgtcgtctgaggtcgggcgtggacgaggcacgatagnnnnnnnnnnnnnnn

SEQ ID NO: 176547 - DNA, 380 bp, Homo sapiens
  misc_feature: GYAE6OF01B7FFQ.23.6.A06.1.454.CMB.1.raw
  modified_base (369)..(369): a, c, t, g, unknown or other
  misc_feature (369)..(369): n is a, c, g, or t
  modified_base (374)..(380): a, c, t, g, unknown or other
  misc_feature (374)..(380): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgctagtttacttctgtcagcagcgttccgccacgccgctcactttcggcgggggaccagggtggagatgagacgaactgtggctgcacatctgtcttcatcttcccgcatctgaatactcgctctgagcgggctggcaaggcgnatagnnnnnnn

SEQ ID NO: 176548 - DNA, 384 bp, Homo sapiens
  misc_feature: GYAE6OF01B420G.23.6.A06.1.454.CMB.1.raw
  modified_base (374)..(374): a, c, t, g, unknown or other
  misc_feature (374)..(374): n is a, c, g, or t
  modified_base (380)..(384): a, c, t, g, unknown or other
  misc_feature (380)..(384): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgtattttgctagtttacttctgtcagcagcgttccgccacgccgctcacgtttcggcgggggaccagggtggagatgagacgaactggtggctgcaccatctgtctcatcctccgccatctgaactactcgcgtctgaggcgggctggcaaggcncatagnnnnn

SEQ ID NO: 176549 - DNA, 394 bp, Homo sapiens
  misc_feature: GYAE6OF01C4RAS.23.6.A06.1.454.CMB.1.raw
  modified_base (379)..(394): a, c, t, g, unknown or other
  misc_feature (379)..(394): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgctagtttacttctgtcagcagcgttccgccacgccgctcactttcggcgggggaccagggtgagatgagacgaactgtggctgcacatctgtctcatctcccgcagtctagatactcgcgtctgagcgggctggacgtaaggcgtcataggcnnnnnnnnnnnnnnnn

SEQ ID NO: 176550 - DNA, 511 bp, Homo sapiens
  misc_feature: GYAE6OF01BEVAO.23.6.A06.1.454.CMB.1.raw
  modified_base (239)..(239): a, c, t, g, unknown or other
  misc_feature (239)..(239): n is a, c, g, or t
  modified_base (495)..(511): a, c, t, g, unknown or other
  misc_feature (495)..(511): n is a, c, g, or t
tcagacgcgagtatcacgaccggtgctcgatttagatctactgacagggccagtaggagtgtcagtaagtacttaggctggtaccaacagaaacctggccaggcctcccaggcctcctcactccatgatgcatacccaacgacgggtcccctgggccgtccccagacgtacgggttcccgtggcaggtggggtcgtggggacagtagttcactctcaccgtcacgcacgccgtgggacnccgtgatgtattttgacttagttttacttctgtcagcgacggtccgttcccgcctaccgcccgtctccgtacggtttccgggggccggggggaccgtggggtggaggagtggaaggaccggtacgtggtcggtcgtcgaccacctatcgttcgtttccttacgtcttcccttccccgactacgtctaacgtaactacgtccggtccgttcgtcggacgggcgggtacgtcgggtacgacgggtcgacctagtacgnnnnnnnnnnnnnnnnn

SEQ ID NO: 176551 - DNA, 685 bp, Homo sapiens
  misc_feature: GYAE6OF01BMJZI.23.6.A06.1.454.CMB.1.raw
  modified_base (204)..(204): a, c, t, g, unknown or other
  misc_feature (204)..(204): n is a, c, g, or t
tcagacgcgagtatcacgaccggtgctcgatttagatctactgacaacgacacaagggggcagaagtctctctcagtcaggacacagcatggacatgagggtccctgctcagctcctgggactcctgctgctctggctccaggtatcagatgtgacatccagatgacccagtctccatccgtccctgtcctgcgtctgtggganccagagtcaccatcacttgaccgggcagtcaggacattaacaactatttacgcctaggtatcagcaagtaaaccgaagggtaaagtacccttaaaatcccgtagacttcgtaatgggttgactactccaacgtttcgacaaacgttcgaacggggtcctccccagttacctacggaactttccgaacggccggaccttagggtacggtacttaccgggttagggacggtaacgttacgtttctaacgggttccttacctaaccgactccgtaacgccgacgtaccgtcgacgtaacgtccgtaggaacgtacgttacggaccttaaactttacgttactaaggtaacctaaaaaggttacgtaaactacggttacccgtttaccccctttagttaccccggtttaaccggcccggtttaaccgggaacttaacggttacggtaaggtaaccggttaccgaaaaccggttacggttaccggg

SEQ ID NO: 176552 - DNA, 517 bp, Homo sapiens
  misc_feature: GYAE6OF01CPLEZ.23.6.A06.1.454.CMB.1.raw
  modified_base (482)..(482): a, c, t, g, unknown or other
  misc_feature (482)..(482): n is a, c, g, or t
  modified_base (493)..(517): a, c, t, g, unknown or other
  misc_feature (493)..(517): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacgaggttccgtggcaggtgggtctgggacagtagttcactctcaccgtcagcagcctggagcctgatgtacttttgctagttttacttctgtcagccaggtccgttcccgaccgaccgcccgtaccgttcctaccggtttccgggggccggggggaaccgagggggttaggaggtagtagggaaacggaacgtaacggtgggttcggccttacggccaaccgtagttccgttgttccctttacctacttcccgttccccgaccttacgttacctagtaaaccttccgtcggtcttcgtaggaccgggtcggacgttggacgtacggngtaccagtgannnnnnnnnnnnnnnnnnnnnnnnn

SEQ ID NO: 176553 - DNA, 437 bp, Homo sapiens
  misc_feature: GYAE6OF01BMGJN.23.6.A06.1.454.CMB.1.raw
  modified_base (397)..(397): a, c, t, g, unknown or other
  misc_feature (397)..(397): n is a, c, g, or t
  modified_base (400)..(437): a, c, t, g, unknown or other
  misc_feature (400)..(437): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgcccgctcactttcggcgggggaccagggtgagatgagacgaactgtggctgcaccatctgtccttcacttccttccccgcctatcctgaatacctcgccgttctgacggcgggtctgggaccaagggtcgaccagtagntgnnnnnnnnnnnnnnnnnnnnnnnnnnnnnnnnnnnnnn

SEQ ID NO: 176554 - DNA, 417 bp, Homo sapiens
  misc_feature: GYAE6OF01A3DM1.23.6.A06.1.454.CMB.1.raw
  modified_base (213)..(213): a, c, t, g, unknown or other
  misc_feature (213)..(213): n is a, c, g, or t
  modified_base (362)..(362): a, c, t, g, unknown or other
  misc_feature (362)..(362): n is a, c, g, or t
  modified_base (387)..(417): a, c, t, g, unknown or other
  misc_feature (387)..(417): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggancctgatgattttgctagttttacttctgtcagcagcgttccgccacgcccgctccactttcgggcgggggacacgggtggagatcgagacgaacgtgtgcgtgcaccatctgtcttacgactcttcccgcatctagaactactcgctcngagcggctggacaaggcacaatagnnnnnnnnnnnnnnnnnnnnnnnnnnnnnnn

SEQ ID NO: 176555 - DNA, 439 bp, Homo sapiens
  misc_feature: GYAE6OF01EYX7B.23.6.A06.1.454.CMB.1.raw
  modified_base (202)..(202): a, c, t, g, unknown or other
  misc_feature (202)..(202): n is a, c, g, or t
  modified_base (409)..(439): a, c, t, g, unknown or other
  misc_feature (409)..(439): n is a, c, g, or t
tcagacgcgagtatcacgaccggtgctcgattttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtnagcagcctggacgcctgatgtattttgctagtttacttctgtcagctagtccgttcccgccacgcccgctcaccgtttcgggcggggggaccaggggtggaagtagtggaagacgaacgtgaggctggccacattctttctcattccttcccgctatctgaatactcgctctggagcgggctggacgtaacggcgtccaatacggtnnnnnnnnnnnnnnnnnnnnnnnnnnnnnnn

SEQ ID NO: 176556 - DNA, 416 bp, Homo sapiens
  misc_feature: GYAE6OF01A7S39.23.6.A06.1.454.CMB.1.raw
  modified_base (405)..(416): a, c, t, g, unknown or other
  misc_feature (405)..(416): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggacgcctgatgtattttgctagttttactctgtcagcagtcgttccgccacgccgctctacgtttcggggcggggggaccagggtggagagtgaacgacgaactggtcggctgcaccatctgtcttcacttccttcccgctatctagaactaccgtcgcgtcgtggacggcgggctggacgaaggcgacatacgnnnnnnnnnnnn

SEQ ID NO: 176557 - DNA, 709 bp, Homo sapiens
  misc_feature: GYAE6OF01CTN3X.23.6.A06.1.454.CMB.1.raw
  modified_base (150)..(150): a, c, t, g, unknown or other
  misc_feature (150)..(150): n is a, c, g, or t
  modified_base (155)..(155): a, c, t, g, unknown or other
  misc_feature (155)..(155): n is a, c, g, or t
  modified_base (162)..(162): a, c, t, g, unknown or other
  misc_feature (162)..(162): n is a, c, g, or t
  modified_base (168)..(168): a, c, t, g, unknown or other
  misc_feature (168)..(168): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
tcagacgcgagtatcacgaccggtgctcgatttagatctactgacaacacacgaagggggcagaagtctctctcagtcaggacacagcatggacatggagggtccctgctcagctccgtggactcctgctgctcgtcggctccgaggtancgagntgtgacntcagtntcgacccngtccnccatcctccgtgtccgtgtccgttcgtagggtcgggacaccaggtaccnccaccgtatccgtacggtcgggcccgggtgtacgtcgaacggtaactaacttaaacgtaactttagttacggccgttaggtactcgaacgtacgaaacggaaaccggtaaggtaaacctaaccgtaaactcgtagtattcgtagtcgtctacacttccgtagttcgactaagcgacgtcctaccgtntctcgtatcgacgcgtatcggtntacgtcggtagtacgtagttacgtcgtaccgttacgtacctacgtacgtacgtacgtacgcgtacgtaccgtacgtacgaccgtacggtaacgttacggtacgttaccttaagtttaacgttaacgttaacgtaaccgttaaagttaccgtaacgttccgttaccggtttaccccttaccgggttacccgttaccggtacccggttaacgttaaccgtaacggtttaccggtaacggtaaaccgttaaccggtaacgtaacgggtccgg

SEQ ID NO: 176558 - DNA, 798 bp, Homo sapiens
  misc_feature: GYAE6OF01B2VO2.23.6.A06.1.454.CMB.1.raw
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (251)..(251): a, c, t, g, unknown or other
  misc_feature (251)..(251): n is a, c, g, or t
  modified_base (410)..(410): a, c, t, g, unknown or other
  misc_feature (410)..(410): n is a, c, g, or t
  modified_base (589)..(589): a, c, t, g, unknown or other
  misc_feature (589)..(589): n is a, c, g, or t
tcagacgcgagtatcacgaccggtgctcgatttagatctactgacaacacacgaagggggcagaagtatctctcagtcaggacacagcatggacagtggacgggtccctgacctcgagtctccgtgggacctcctgctgctctcggcctcccgaggttacncgtagntggtcacctatccgagtactcgaccctagtcctccacttccctcctcgtctcgtcgtcgtaggcggcgccaggctcctaacctntaccgtacgttcggaccgggtacgtacgtacgacggtaacctaactttaacctaaccgtttatttaccggccttggggtaacttacccgagaacgaaacgtaaccggtaaagggtaaccttaaccctaaaccgttccgtacgtacttactacgttggtntaccaaccttctaactttcgacctaacgtccggaagtcccctactacggttacctctacgtaccgaccggtacccggtataggtcggtacttacgggtacggtaaggttacgttaaccgttcgtaaccggtccttacccgacctacgtactacggtaccgtaacgtccgtaacccggtntacccggaacccttaagggtacccgttaacgttcggtaaacccttttaccgttaaagtttacccgtaaacgttaccgtaaaacgttacggttaaaccctcggttaccccctttaccgtttaaccgttaccggttccccggtacggacccgttaagtaaccggtaccgttaagggttaacccggtaacgtaaaccggttcgttacccggg

SEQ ID NO: 176559 - DNA, 853 bp, Homo sapiens
  misc_feature: GYAE6OF01DBJ06.23.6.A06.1.454.CMB.1.raw
tcagacgcgagtatcacgaccggtgctcgatttagatctactgacaacacacgaagggggcagaagtctctctcagtcaggacacagcatggacatggacgggtccctgctcagctccgtgggactcctgctgctctggcctccgaggtactcgagatgtgactactccagactacggaccctagttcctccctactcccttcccgtgtcctcggtccggttcgtagggtcgggacgaccgaaggtacgtaccaccgtattccgtacggttccgggccggggtacgtaacgtacgaacggtaaccttaaatttaaaccgtaacgttttacgtttaaccggaccgttagggttaactaccgaacgtaaccgtaaaacgggaaaaacccgtaaagggggtaaaaaccctttaaacccttaaaccgttccggtaaggttaacttccgttaaggttccgggtaacacccttaactttaccccgttagtttacgaacgtaaccgtcgggtaccggtacccttacccgtattccgtacgtactacggacggcggtactacgggtggtaggttcggtaagggacgttaagtttcgttaccgtacgtacctaaccgtactacgtacgacggtacccgagtcccgttaggaccgttagaccgttaaggaaccggtttctaaccgtaacgtttacgtttaacgtaacgttaaagttaaccgtaaacgtttaccgtacggtccgtttaccccgtttacccgtttaccgtttaacccgggttttcccggtaaccggtaaacggtacccgttaaagggttacggttaaacccggaccgttaaaacccggaggttccggttaacggg

SEQ ID NO: 176560 - DNA, 883 bp, Homo sapiens
  misc_feature: GYAE6OF01EPNV8.23.6.A06.1.454.CMB.1.raw
  modified_base (177)..(177): a, c, t, g, unknown or other
  misc_feature (177)..(177): n is a, c, g, or t
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
tcagacgcgagtatcacgaccggtgctcgatttagatctactgacaacacacgaagggggcagaagtctctctcagtcaggacacagcatggacatggacgggtccctgcctcagcctccgtagggctccgtgctcggctcgtacggcctcccgtaggtactcgagtagttacggtnacacgtaccgaagtactacggaccctaggttcctccctaccttccccgtcccgttgttccgtcggtaccgttcgttagggacgggacgtaccaagtcgtaccaccgtatcgacgttccggcggggtacagtcgaaggtaacctaataaccgtaagttacttacgtcgtagtacncgacgacgaaacggtaaaccggacgggtaaaactaccttaacgctacgtatcgtaaggtcgtacnctacgttccctgtacactacgtaccaccggttcctacacgttcgtaaccgttacgtacggacggtcggtacgtaggtgttaccgaggttacggacgttacgttagttcgacgttaccctacgtacccgtataccgtacgaccgtacggttaccgacggaactacccggttaccgggtacgttaaaccgttaccggttaacccgtttaaacgtttaaccgtttttaccgtaaacgtttaacccgtttaaaaaacgtttaaaccggttaaaccccggtttaacggttcccgggtttaacccccccttttaccgggtttaaaccccgttaccccgggggttttaaaccccggttacccgggtttaaacccccgggttaagggttaaaccggtttaaaccgggggtttaaaaccgggtaacccgggtttaaaaaaccccccggttgggttaacccggtttaacccgggggg

SEQ ID NO: 176561 - DNA, 595 bp, Homo sapiens
  misc_feature: GYAE6OF01A7KRR.23.6.A06.1.454.CMB.1.raw
  modified_base (462)..(462): a, c, t, g, unknown or other
  misc_feature (462)..(462): n is a, c, g, or t
tcagacgcgagtatcacgaccggtgctcgatttagatctactgacaacacgacaaggggacccaaaaaccacacccctccttgggagaatccccctagatcaccagcctccgcaccatggactggacctggagcatccttttcttggtggcggcagcaacaggtgcccactcccaggttcaactggaacaatctggagctgaggtgaaagaggcctggggcctcagtgaaggtctcctgcaaggcttctggttacattctttaggaactatcgactaatcaacgtggtgcgacaggcccctggacaagggcttagaggtggagtgggggtgatcgagtcgtcgtacgatgaattaacacagtactttgacacgagaagttccgaaggcgagacgttccacatagagacaacaagacaactactacccgaagacgactaacacgtactaacagtacggaacgnggaacggactcgtcgaactactcgtacggaaccgtacgaccgggtaccgttaggtaattaacgttgtaccggaacgtagggagggtacaacggtacaccgttagtaggttggtggtttgcgttgcggtacggg

SEQ ID NO: 176562 - DNA, 755 bp, Homo sapiens
  misc_feature: GYAE6OF01DV6MY.23.6.A06.1.454.CMB.1.raw
  modified_base (207)..(207): a, c, t, g, unknown or other
  misc_feature (207)..(207): n is a, c, g, or t
tcagacgcgagtatcacgaccggtgctcgatttagatctactgacaacgacacgaaggggcagaagtctctctcagtcaggacacagcatggacatgaggtccctgctcagctcctggactcctgctgctctggctccaggtatcagatgtgacatccagatcgaccagtcctccatccctcctgtctgccttcgtaggtcgggacncctagtacgtccaaccgtattccacgtttcggcccgggtagacgtcgacggactagttaacaactatttacgctgtactcagtcacgaaacgaggtaaacgtacctaaacgtccgtagatcgtatgtcgcatccactttcgactaacgtcgaacggtcctacccgtattaccgtacgtaaactttcgaacgggtcccggtacgttacgggtacgggtacttaccgggtaacggggtaaccgttaaaggttacttttaccgtaacggttaccttaacccggaaacccgtaacgtacccgtagtaacccgtcgtacccgttaggtacccacgtaccgttacgaaacggtttccgttaagtaacccgtttaacgtttacgttaacgttaacggttaaccgtaaaaacggtttaacgtaacgttaaaccgggttaccgttaacccccgttttaccggttaacccgtttaccgggttaaccccgttacggggtaaacccttaacggttacggttaaacggaccggtttaaccgaaacgtttaccgggtacggg

SEQ ID NO: 176563 - DNA, 384 bp, Homo sapiens
  misc_feature: GYAE6OF02FNFM6.23.6.A06.1.454.CMB.1.raw
  modified_base (373)..(373): a, c, t, g, unknown or other
  misc_feature (373)..(373): n is a, c, g, or t
  modified_base (379)..(384): a, c, t, g, unknown or other
  misc_feature (379)..(384): n is a, c, g, or t
tcagacgcgagtatcacgaccggtgctcgatttagatctactgacagggccgagtaggagtgtcagtaagttacttaggctggtaccaacagaaaccgtggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcgggggaccaggggtggagatgagacgaactgtggctgcaccatctgtcttcatcttccgccatctgaatactcgcgtctgagcgggctggcaaggcncatagnnnnnn

SEQ ID NO: 176564 - DNA, 381 bp, Homo sapiens
  misc_feature: GYAE6OF02HCXEX.23.6.A06.1.454.CMB.1.raw
  modified_base (376)..(381): a, c, t, g, unknown or other
  misc_feature (376)..(381): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcgggggaccagggtggagatgagacgaactgtggctgcaccatctgtcttcatcttcccgccatctgaatactcgcgtctgagcgggctggcaaggcgcatagnnnnnn

SEQ ID NO: 176565 - DNA, 382 bp, Homo sapiens
  misc_feature: GYAE6OF02FIW98.23.6.A06.1.454.CMB.1.raw
  modified_base (377)..(382): a, c, t, g, unknown or other
  misc_feature (377)..(382): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcggggggaccagggtggagatgagacgaactgtggctgcaccatctgtcttcatcttcccgccatctgaatactcgcgtctgagcgggctggcaaggcgcatagnnnnnn

SEQ ID NO: 176566 - DNA, 382 bp, Homo sapiens
  misc_feature: GYAE6OF02I35D1.23.6.A06.1.454.CMB.1.raw
  modified_base (373)..(382): a, c, t, g, unknown or other
  misc_feature (373)..(382): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcggggggaccagggtggagatgagacgaactgtggctgcacatctgtcttcatctcccgcatctgatactcgcgtctgagcgggctggcaaggcgcatagnnnnnnnnnn

SEQ ID NO: 176567 - DNA, 379 bp, Homo sapiens
  misc_feature: GYAE6OF02HHBRT.23.6.A06.1.454.CMB.1.raw
  modified_base (375)..(379): a, c, t, g, unknown or other
  misc_feature (375)..(379): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgctagtttacttctgtcagcagcgttccgccacgccgctcactttcggcgggggaccaggggtggagatgagacgaactgtggctgcaccatctgtcttcatcttccgccatctgaatactcgcgtctgagcggctggcaaggcgcatgnnnnn

SEQ ID NO: 176568 - DNA, 385 bp, Homo sapiens
  misc_feature: GYAE6OF02HQO92.23.6.A06.1.454.CMB.1.raw
  modified_base (369)..(369): a, c, t, g, unknown or other
  misc_feature (369)..(369): n is a, c, g, or t
  modified_base (375)..(385): a, c, t, g, unknown or other
  misc_feature (375)..(385): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttactctgtcagcagcgttccgccacgccgctcactttcggcgggggaccagggtggagatgagacgaactgtggctgcaccatctgtcttcatcttcccgccatctgaatactcgcgtctgagcgggctggcaaggcncatagnnnnnnnnnnn

SEQ ID NO: 176569 - DNA, 382 bp, Homo sapiens
  misc_feature: GYAE6OF02HPV69.23.6.A06.1.454.CMB.1.raw
  modified_base (375)..(382): a, c, t, g, unknown or other
  misc_feature (375)..(382): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcgggggaccagggtggagatgagacgaactgtggctgcaccatctgtcttcatcttcccgcatctgaatactcgcgtctgagcgggctggcaaggcgcatagnnnnnnnn

SEQ ID NO: 176570 - DNA, 383 bp, Homo sapiens
  misc_feature: GYAE6OF02FYBMM.23.6.A06.1.454.CMB.1.raw
  modified_base (350)..(350): a, c, t, g, unknown or other
  misc_feature (350)..(350): n is a, c, g, or t
  modified_base (374)..(383): a, c, t, g, unknown or other
  misc_feature (374)..(383): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgcagtttacttctgtcagcagcgttccgccacgccgctcactttcggcgggggtaccagggtggagatgagacgaactgtggctgcaccatctgtcttcatcttcccgcatctgatactcgcgtntgagcggctggcaaggcgcatagnnnnnnnnnn

SEQ ID NO: 176571 - DNA, 453 bp, Homo sapiens
  misc_feature: GYAE6OF02G70VS.23.6.A06.1.454.CMB.1.raw
  modified_base (213)..(213): a, c, t, g, unknown or other
  misc_feature (213)..(213): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (421)..(453): a, c, t, g, unknown or other
  misc_feature (421)..(453): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggancctgatgattttgctagtttacttctgtcagcagcgttccgccacgccgctcactttcgggcgggggaccagggtggagatgagacgaactgtggctgcaccatctgtcttcacttccttcccgcctatctagaacttacctcgcgtcgttgacggcgggctcggtacaaggtccgactagtagntgacnctgcngctngctnagctnnnnnnnnnnnnnnnnnnnnnnnnnnnnnnnnn

SEQ ID NO: 176572 - DNA, 426 bp, Homo sapiens
  misc_feature: GYAE6OF02IF22J.23.6.A06.1.454.CMB.1.raw
  modified_base (216)..(216): a, c, t, g, unknown or other
  misc_feature (216)..(216): n is a, c, g, or t
  modified_base (411)..(426): a, c, t, g, unknown or other
  misc_feature (411)..(426): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacagggttccgtggcaggtgggtctggggacagagttcactctcaccgtcagcagcctggancctgatgtatttttgtagttttacttctgtcagcagtccgttccgccacgccgctcacgtttccgggcggggggaccaggggtggagagtgagacgtaacgtggtggctgcaccatctgtcttcattccttcccgctactctgtaactactcgtcgtctggacggcgggcgtcgggacgaagggccgacagtagnnnnnnnnnnnnnnnn

SEQ ID NO: 176573 - DNA, 587 bp, Homo sapiens
  misc_feature: GYAE6OF02JIG94.23.6.A06.1.454.CMB.1.raw
  modified_base (172)..(172): a, c, t, g, unknown or other
  misc_feature (172)..(172): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
  modified_base (541)..(541): a, c, t, g, unknown or other
  misc_feature (541)..(541): n is a, c, g, or t
  modified_base (546)..(549): a, c, t, g, unknown or other
  misc_feature (546)..(549): n is a, c, g, or t
  modified_base (553)..(579): a, c, t, g, unknown or other
  misc_feature (553)..(579): n is a, c, g, or t
  modified_base (581)..(587): a, c, t, g, unknown or other
  misc_feature (581)..(587): n is a, c, g, or t
tcagacgcgagtatcacgaccggtgctcgatttagatctactgacagggccagtaggagtgtcagtaagtacttagctggtaccaacagaaacctggccaggctcccaggctcctcatccatgatgcatccaacagggtccctggccgtcccagacacggttccgtgggccnggtggggtcctggggacaggtacgttacactcttcgacccgttcgacgccagtccgtgggacgtcctagtactggtacttttgactacgttttactcgtggtcaggctaacggtcgtttcccgactaccggccggtctaccgtacgtttcccgggggnggggggacccaggggttgggaanaccgttggaaacggtacctaagtcggttaggggccacggccaaccgtattcgttactcgttcaccgttcctttcccgaccgttattcgttagtaaacgtttccgccacggtttcaacggcgggttaccgggggactttgggggaaacgtaccggggtccacctaagggtacgctcaaatgggaaaccngttannnngcgnnnnnnnnnnnnnnnnnnnnnnnnnnncnnnnnnn

SEQ ID NO: 176574 - DNA, 845 bp, Homo sapiens
  misc_feature: GYAE6OF02IGVYX.23.6.A06.1.454.CMB.1.raw
  modified_base (258)..(258): a, c, t, g, unknown or other
  misc_feature (258)..(258): n is a, c, g, or t
tcagacgcgagtatcacgaccggtgctcgatttagatctactgacaacgacacaaggggacccaaaaaccacaccctcttgggagaatccctagatcacagctccgcaccatggactggacctggacgcattccttttcttggtggcggcagcaacaggtcgcccactcccaggttcaactggaacaatctggagctgaggtgaaggaggccgtggggcctcgagtgaaggtctccgtgcaaggtcttcgtggttacnttactttaggaacttatggactatacaacgtgggtagcgaacgacggtcccctaggaaccgaagggtcttacggaggttgggaacgttgggggtacgtagtacgaggtaccggttacgtaaccggagttcggaataaccgtaacgtacggtaaccttttggacctaaacgtacggtaaacgtttcccggaacgggtaccgtaaggtaccgttacctaccggtacgtacgggaacgtaccaccgtaacgaacccaaccgtaaccgtaccgaaccggtaacgaccctaaaccgtacggttaacctaacgttaacgtaacggggtaaccgttaagggtacgggtaacggttacgtacgggtaaccgtacgttaccggttaacggacggtaaccgggaaccgggttaaccggttacggtttaaacgttttaacggtttacgggttaccgggtaacggggtaacggggtacggggggtaaccctaaccgggttaacggtttacccggtttaaggtttaacgggggttcggggttttaaccggggttacgggttaccggtttacggggtaccgggtttttaaacccggggggg

SEQ ID NO: 176575 - DNA, 413 bp, Homo sapiens
  misc_feature: GYAE6OF02FRFSC.23.6.A06.1.454.CMB.1.raw
  modified_base (213)..(213): a, c, t, g, unknown or other
  misc_feature (213)..(213): n is a, c, g, or t
  modified_base (318)..(318): a, c, t, g, unknown or other
  misc_feature (318)..(318): n is a, c, g, or t
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
  modified_base (403)..(413): a, c, t, g, unknown or other
  misc_feature (403)..(413): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggancctgatgtattttgctagtttacttctgtcagcagtccgttccgcccacgcccgctcctacgtttcgggcgggggtaccaggggtgagatggagacgaacgtggnggctcgacaccattctgttccttctactccttccgctatctanaactctcgctctggacgcgggtctcggacaagggcnctatgnnnnnnnnnnn

SEQ ID NO: 176576 - DNA, 662 bp, Homo sapiens
  misc_feature: GYAE6OF02FY9XK.23.6.A06.1.454.CMB.1.raw
  modified_base (217)..(217): a, c, t, g, unknown or other
  misc_feature (217)..(217): n is a, c, g, or t
  modified_base (572)..(572): a, c, t, g, unknown or other
  misc_feature (572)..(572): n is a, c, g, or t
  modified_base (577)..(578): a, c, t, g, unknown or other
  misc_feature (577)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcactccaacacgggtccctggcgtcccagacaggttccgtggcagtgggtctgggacagagttcactctcaccgtcagcacgcctggacnccctgactgtacttttgcacgttttacttctggttccacgcctacggtcccgttcccgcccgaccggtccccgtccttccgtaacccggtttacccgggggcccgggggggggtaacccgtacgggggttacggggactaacttacggaacggtaaccggtaaacgttggttggggtcctacgggacccctaaacccgcgtttacccgttacgttccccgtttacctaccgtttaccccgtttccccccggccctaacgttccgtacgtaaaccgttaacccgtcccgtaccgggttccgtacgggaccggtcccgggggccttacgggacctaacgggccaccgtacgacggtnactcnncncncgccncncncncncncncncncncncncacgcgcgcncncacncncncncncncncncnctncncacncncncacgntnc

SEQ ID NO: 176577 - DNA, 896 bp, Homo sapiens
  misc_feature: GYAE6OF02JA1U7.23.6.A06.1.454.CMB.1.raw
tcagacgcgagtatcacgaccggtgctcgatttagatctactgacaacgacgacaaggggacccaaaaaccacacccctccttgggagaatcccctagatcacagcctccgcaccttatggactggacctggagcatcctttcttggtggcggcagcaacaggtgcccactcccaggttcaacgtcggaactaatcgtggagctggaggtgaagacggccgtggggccctcgaggtgaacggtcctccgtgacgtaaggtcttcgtcggttaccagttacgtttaaggaacttagttgaaccgttattaccgaaccgttggggttacgaccggaaccgaccgggtcccccttagggaaccgtaaacgggggtcctttacgggtaaggttacgggtacggtttacggggggtaggtaacgttccggaacgggttccggttaaccggttaaccggaatttacgggaacttaaacccgacgttaaacggtaaccttttcggaaccgtaacgtaaacggtaaaccggtttacccggaagggggaccgtaaaggttaccggttcggtttaaacccccgtaaggtttaccgggaacggtaaccaacccggtaaggtaaacccgtaacccgtaaccgttacccgaaaccggtaccggtaaccgtaaccgtaaccggttaaccttaaccggtaaagttaccgggaacgttacgggtaacgggtaaccgtacgttaacggaacttacgtccgttaaacgacccggtaccggtaaccgtaccggtttagtttaacttcggttaggtcgggacggtacgggtacgggtacctaaccgtaccgttcgttaacgggttcgggtttacggttccgggttactacgggttacggtccgggtttaacccggg

SEQ ID NO: 176578 - DNA, 610 bp, Homo sapiens
  misc_feature: GYAE6OF02I113O.23.6.A06.1.454.CMB.1.raw
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
  modified_base (531)..(533): a, c, t, g, unknown or other
  misc_feature (531)..(533): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (544)..(545): a, c, t, g, unknown or other
  misc_feature (544)..(545): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (585)..(585): a, c, t, g, unknown or other
  misc_feature (585)..(585): n is a, c, g, or t
  modified_base (610)..(610): a, c, t, g, unknown or other
  misc_feature (610)..(610): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagtagttcactctcaccgtcagcgagccgtggacgtccgtgtatcgtagttttgacttaacgttttccttcgtgtctagcctacggtcccggttaccgcccaccggtacccgtcctaccgtttaccggtttcccggggggacccggggggtacgacggggttggtacgagtaggtacggaacgttacggttggtcggtctcgaacctacgtattcccttagttcttaccaccttccgtcccgacgtactgttaacgaccttaccggtccgtcgttcgtacggacggggtccggtacggttcgggaccgtaacggcccgtaatacgtacgatcgtagnacgntgnacgannnacgngngcacnntcncgcacnacgagngcgacgtcgtntntagcactacgtnacgtgtcgtacgtatggtcgactgn

SEQ ID NO: 176579 - DNA, 462 bp, Homo sapiens
  misc_feature: GYAE6OF02J1JX8.23.6.A06.1.454.CMB.1.raw
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (391)..(391): a, c, t, g, unknown or other
  misc_feature (391)..(391): n is a, c, g, or t
  modified_base (421)..(422): a, c, t, g, unknown or other
  misc_feature (421)..(422): n is a, c, g, or t
  modified_base (424)..(462): a, c, t, g, unknown or other
  misc_feature (424)..(462): n is a, c, g, or t
tcagacgcgagtatcacgaccggtgctcgatttagatctactgacagggccgagtaggagtgtcagtaagtacttaggctggtaccaacagaaacctggccaggctcccaggctcctcatccatgatgcatccaacagggtccctggcgtcccagacaggtccttggcagtgggtctgggacagagttcactctcaccgtcagcanccctggancctgatgattttgcagtttacttctgtcagcaggccgttccgccacgccgctcacgtttccgggcgggggtaccaggggtggaacgagtaggacggacgaacgtggtggcctggccaccatctagtctcatccttcccgcctatctagtaactctcgcgtcgtcgaagggtccgggntacgggaccgtaagggcccgataattcggnngnnnnnnnnnnnnnnnnnnnnnnnnnnnnnnnnnnnnnnn

SEQ ID NO: 176580 - DNA, 612 bp, Homo sapiens
  misc_feature: GYAE6OF02JXB7R.23.6.A06.1.454.CMB.1.raw
  modified_base (503)..(503): a, c, t, g, unknown or other
  misc_feature (503)..(503): n is a, c, g, or t
  modified_base (534)..(534): a, c, t, g, unknown or other
  misc_feature (534)..(534): n is a, c, g, or t
tcagacgcgagtatcacgaccggtgctcgatttagatctactgacagggccagtaggagtgtcagtaagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggacgtctcgatgtattttcgctacgtttactcgtgtccagtcagtccgttccgccacggcctctcctacgtttcgggggaccggggtaccagggggttacgaggtagtaggacggtaaccggtaagtcggttcggtaccgtaggaccctaccgtaaccgttcgtaggttaccttacgtaccgttcccggttcccggacctaagttccgtagtaaccttacgttccggccgttacgtcggaacggttccggcgttacgggactaacggtcgaacaaggtcgagtcgagagtcgngcgcgcgcgcgagcgacgcgcgagacgacgnacgtacacgtcgtcgcgacgacgacacacgtgacgtgtctacgtacgtacgtgacgtcgtagtagtcgtcgtaccgtc

SEQ ID NO: 176581 - DNA, 504 bp, Homo sapiens
  misc_feature: GYAE6OF01D7HTG.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgagcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgctttctctgcctccaagtctggcaacacggcttccctgaccatctccggctccacgctgagacgaggctcattattactgcagctcatatacacccgagggcactctcgtgagttagttcggcggacgggacctggcctcgaccgtcctaccgtcaggtaccccg

SEQ ID NO: 176582 - DNA, 500 bp, Homo sapiens
  misc_feature: GYAE6OF01B7BKW.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaaatcgcttctctgcctcaagtctggcaacacggcttccctgaccatctccgggctccacgctgagacgaggctcattattactgcagctcatatacaccagggcaactctcgtgattagttcggcggagggacctggctcgaccgtcctacgtcagcccaacggg

SEQ ID NO: 176583 - DNA, 500 bp, Homo sapiens
  misc_feature: GYAE6OF01CTENH.10.72.G06.1.454.CMB.1.raw
  modified_base (490)..(490): a, c, t, g, unknown or other
  misc_feature (490)..(490): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccgaggggcactctcgtgatagttcggcggagggcctggctgacccgtctacgtcngccctaacgg

SEQ ID NO: 176584 - DNA, 500 bp, Homo sapiens
  misc_feature: GYAE6OF01EGTFH.10.72.G06.1.454.CMB.1.raw
  modified_base (490)..(490): a, c, t, g, unknown or other
  misc_feature (490)..(490): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttccctgaccatctccgggctccgacgctgaggacgaggctcattattactgcagctcatataccaccgagggcactctcgtgatacgtcgggcgagggcctggctcgaccgtcctacgtcngcccgaacgg

SEQ ID NO: 176585 - DNA, 518 bp, Homo sapiens
  misc_feature: GYAE6OF01EAS88.10.72.G06.1.454.CMB.1.raw
  modified_base (506)..(506): a, c, t, g, unknown or other
  misc_feature (506)..(506): n is a, c, g, or t
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccaggccacggccccagacctcatcatttctgatgtcagtgatcggtccctttgggactttctaatcgtcttctctcgcctcagtctggcaacacggtcttcctgaccatccgtccgggctccacgcgtgacggacgaggctactattacttactgcagctcatactaccaccgagggcacgtctcgtgattagtcggaggacgggcctcggctcgtaccgtcctacgtcncgcccgtaacgg

SEQ ID NO: 176586 - DNA, 503 bp, Homo sapiens
  misc_feature: GYAE6OF01CHCOX.10.72.G06.1.454.CMB.1.raw
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttccctgaccatctccgggctccacgctgaggacgaggctcattattactgcagctcatataccacccgagggccactctcgtgatagttcggnggacgggcctggctcgaccgtcctagtccngccctaacgg

SEQ ID NO: 176587 - DNA, 505 bp, Homo sapiens
  misc_feature: GYAE6OF01CCUEF.10.72.G06.1.454.CMB.1.raw
  modified_base (491)..(491): a, c, t, g, unknown or other
  misc_feature (491)..(491): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttccctgaccatctccgggctccacgctgacggacgaggctcattatactgcagctcatatacaccagggcactctcgtgatacgttcggacggacgggccgtggctcgaccgtcctacgtcncgtcccgtaacggg

SEQ ID NO: 176588 - DNA, 491 bp, Homo sapiens
  misc_feature: GYAE6OF01BWKHI.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttcctgaccatctccgggctccacgctgaggacgaggctcattattactgcagctcatatacacccagggccactctcgtgatagtcggcggaggctggctgaccgtcacgtcagcccaacgg

SEQ ID NO: 176589 - DNA, 530 bp, Homo sapiens
  misc_feature: GYAE6OF01B97U0.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctcgcctcaagtctggcaacgacggtcttccctgaccatctccgggctccgacgctgacggacgaggctctattattactgcagctcatactacacccgagggcactctcgtgtagtacgttcggacggagggcccgtcggcgttacggtacccgttaccgtaccgtccgacgccccgtaacggg

SEQ ID NO: 176590 - DNA, 491 bp, Homo sapiens
  misc_feature: GYAE6OF01EEI0G.10.72.G06.1.454.CMB.1.raw
  modified_base (485)..(485): a, c, t, g, unknown or other
  misc_feature (485)..(485): n is a, c, g, or t
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttggatttctaatcgcttctctggctcaagtctggcaacacggcctccctgaccatctctggctccgaggctgaggacgaggctgattattactgcagctacatactaacaacagcagctacttctgtattcggcggaggacaagctgaccgtctaggtcngacccg

SEQ ID NO: 176591 - DNA, 533 bp, Homo sapiens
  misc_feature: GYAE6OF01BRDYY.10.72.G06.1.454.CMB.1.raw
  modified_base (485)..(485): a, c, t, g, unknown or other
  misc_feature (485)..(485): n is a, c, g, or t
  modified_base (518)..(518): a, c, t, g, unknown or other
  misc_feature (518)..(518): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgactttgtgcttataactatgtctcctggtaccagcaccaccaggcaaagcccccaaactccttgttttgaggtcagtaagcggccctcaggacgtccctgatcggttctctgcctccaagtctggcaacacggcctcctgaccgtctcgtcgggctccaggctgaggatggaggctgattacgtactgcagcgcatacttcacggcccctaagagggttgttgggcggcgggacgtaaggtcgaccgttcgngggtcacggcccaaggcctcgccccgtcggccnctcgtccgttccccg

SEQ ID NO: 176592 - DNA, 519 bp, Homo sapiens
  misc_feature: GYAE6OF01CHPSD.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccaggccaggcccccagactcatcatttctgatgtcagtgatcggccctttgggatttctaatcgcttctctgcctccaagtctggcaacacggcttccctgaccatctccgggctccacgctgaggacgaggctcatttatactgcagctcatataccacccgagggccactctcgtgatagttcgggacgggagggaccctggccccctggtacccgttcctaacgtccgacgcccgtaacggg

SEQ ID NO: 176593 - DNA, 510 bp, Homo sapiens
  misc_feature: GYAE6OF01D4RKL.10.72.G06.1.454.CMB.1.raw
  modified_base (366)..(366): a, c, t, g, unknown or other
  misc_feature (366)..(366): n is a, c, g, or t
  modified_base (465)..(465): a, c, t, g, unknown or other
  misc_feature (465)..(465): n is a, c, g, or t
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacncggcttcctgaccatctccgggctccacgctgaggacgaggctcatttattactgcagctcatactacacccgagggcactctcgtgattagtccgggnggagggtccctgggcctcgacccgtcctacgtccagcccgaacgg

SEQ ID NO: 176594 - DNA, 695 bp, Homo sapiens
  misc_feature: GYAE6OF01CFN38.10.72.G06.1.454.CMB.1.raw
  modified_base (242)..(242): a, c, t, g, unknown or other
  misc_feature (242)..(242): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctctggacagtcgatcactatctcctgcactggcaccagcagtgacataggtncttataactatgtctctggtaccaacaacacccaggccacggcccccagactcactctatttctgatgtcagtgactcggtcctttagggtactttactaactcgtctttctctacgtcctactaacgttcttacgggacctaaacgtaccgggtcctttaccccgtcgtaacccgtacgttcccgttcccgggggtcccttacccgtacccggaccgttagggaaccggggtaacggtacgggtacccttacgttaacttttaactttaaccgtcggtacctaacggtccttaccaactttaacgtaacccgtaaccccggacgggggtaccctaaccgttccgttacggtacggtaacgttacggtttccggggacgggtaacggggtacccgtgggtcccgtaccggtacccgttacccgttacggtaaccgaccggtcccgtaaccggg

SEQ ID NO: 176595 - DNA, 564 bp, Homo sapiens
  misc_feature: GYAE6OF01B75BH.10.72.G06.1.454.CMB.1.raw
  modified_base (552)..(552): a, c, t, g, unknown or other
  misc_feature (552)..(552): n is a, c, g, or t
tcagcatagtagtgcacgaccggtgctcgatttagctacgactgcaaggggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgactcggtccctttgggactttctaatcgtcttctctcgcctcaagtctggaccaacgacggtccttcccgtcgaccctactccgtcccgggcctcccgacggccttaggacgggaccgtacggcctaacgtatttacttaacgtgcagtcctacaatactaccgacccgagggccacgtctcgtgtatacgttcgggcggacggtccgtggtcctcggtacccgtcctaccggtcncgcccgtaacgg

SEQ ID NO: 176596 - DNA, 562 bp, Homo sapiens
  misc_feature: GYAE6OF01DSJY4.10.72.G06.1.454.CMB.1.raw
  modified_base (351)..(351): a, c, t, g, unknown or other
  misc_feature (351)..(351): n is a, c, g, or t
  modified_base (511)..(511): a, c, t, g, unknown or other
  misc_feature (511)..(511): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactggcaccagcagtgacagtaggtgcttataactatgtctcctggtaccaacaacaccaggccacgccccagactcatcatttctgatgtcagtgatccggtcctttgggattttctaatccgcttctcgtcncctctacgtctggaccaacacggtccttcccgtcgacctactccgtcccgggcttcccgacgcctacggacggacgtacggtcctacgtaactttacgttactcgacacgtctacatactaccgacccgagggcctacgtctcgtcgagtacgttcgggnggacgggtcgtcggcttacgacccgttccgtacgtccgacgcccgtaacgg

SEQ ID NO: 176597 - DNA, 642 bp, Homo sapiens
  misc_feature: GYAE6OF01D7ZPB.10.72.G06.1.454.CMB.1.raw
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacgagggtcctgggcccagtctgccctgactcagcctgactccgtgtctgggtctcctggacagtcatcactatctcctgcactggcaccagcagtgactagtaggtgacttataactatgtctctgtaccaacacaccagcacgcccagactcatctatttcnatncagtgacgtcgtccgttggactttctaagtcgtcttctctcgtccctacgtaacgtcgtacggacctaaacgccggtccttcccgtacgtacctacgttccgtccgggtaccctaccgacggtctacggacggaccggtaaggtcctaactacgtttaacgtttactcggtacaacgtacctacgaacttaaccgtaaccgacccggacgggtacctaaccggttccgtacggttacgtaagttaccggtcggggtacgggtaccggggtacccgtcgggtacccgttacggtaccccgttaccgtaacccggttaccgaccggtccccgtaacccggg

SEQ ID NO: 176598 - DNA, 579 bp, Homo sapiens
  misc_feature: GYAE6OF01EDAFL.10.72.G06.1.454.CMB.1.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttaataactatgtctcctggtaccaacaacacccaggccacggccccagactcactcatttctgatgtcagtgatccggtcctttgggatttctaatcgctttctctcgtcctctaagtctggacaacgacggtcttccctgaccctacgtccgtccggggcctccgacgtcgtcggacggacggacggcttactatttacttacgtcgctagccttactaacttaactaccgacccgacggggctaccgttctacggttgagttcggtcgggcgggacgggtaccgtcggccgtcggtacccgttaccgtacggtccaccggccctaaccggg

SEQ ID NO: 176599 - DNA, 656 bp, Homo sapiens
  misc_feature: GYAE6OF01DWT9Z.10.72.G06.1.454.CMB.1.raw
  modified_base (245)..(245): a, c, t, g, unknown or other
  misc_feature (245)..(245): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctggtctcctggacagtcgatcactatcctcctgcactggccaccagcagtgactagtaggtntacttaataactatcgtctcctacggtaaccaaacaaccacccgaggccaccggccccagacctacatctatttctggatcgtcagtcgtacgtccggtccgtttggtactttctaacgtcgtcttctctcgtcctacgtaagtcgtacggacctaacgtaccggtcctttacccgtacgtaccctacgttccccggttcccgggtacccttacccgaccggtaccggtacggtaacgggaccgtacggtcctaacgtagttttaactacgtcgactacgtcctaactaactaaccgaccgacccgagggctaacctcgtacgtacgtacgttacggtccgggacggtacggtccgtcggtaccgtacccggtacccgtacgttaaccgccgaaccgtcccggtaaccggg

SEQ ID NO: 176600 - DNA, 533 bp, Homo sapiens
  misc_feature: GYAE6OF01C6DMN.10.72.G06.1.454.CMB.1.raw
  modified_base (363)..(363): a, c, t, g, unknown or other
  misc_feature (363)..(363): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaaccaacaacacccaggccaggcccccagactcatcatttctgatgtcagtgatcgcctttggatttctaatcgcttctctcgcctccagtctggcaacncgtctcctgaccatctccggctccacgctgacggacgacggctctatttattactgcagctacatactaccgacccgagggcacttctcgtagtagtacgttcgggcggaacgggacccgagggtccgtacgtacccgttacctaagtaccgacggtcccgtaaaccggg

SEQ ID NO: 176601 - DNA, 772 bp, Homo sapiens
  misc_feature: GYAE6OF01A0IQA.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacagtaggtgtcttataactatcgtctcctaggtaaccaacgaacacccaggccacggcccccagacctcactctatttactgactgtcagtgactcggtacccgtttgggtactttacgtaactcgtcttctcgtcgtccctaccgtaagtccgtacggtaccaaaccgtaccgggtccctttaccccgtacgtaacccctagttccccggtcccggggtaccctcccgtaaccggtccgttacggaacgggtaacccggtagggtaccctttaccgtaagttttaaccgtttaaccgtacgtacccgttacgtaccgttaaccgtaacttaacccgtaacccgtaaccccgggtaacgggggtacctaaccccgttaccgttaccggttaccggtaacgttaaccgggttttacccgggggacgggtaacccgggggttaacccgtaccgggttcccgttaaaccggggttacccccgtttaacccggttaaccccggtacccgggtaacccgggtaccccgttaaaccccggggg

SEQ ID NO: 176602 - DNA, 622 bp, Homo sapiens
  misc_feature: GYAE6OF01BSSY6.10.72.G06.1.454.CMB.1.raw
  modified_base (244)..(244): a, c, t, g, unknown or other
  misc_feature (244)..(244): n is a, c, g, or t
tcagcatagtagtgcacgaccggtgctcgatttagctacgactgcaaggggaaagggggggtctcaggaggcagcgctctcgggacgtctccaccatggcctgggctctgctattcctcaccctcctcactcgagggcacagggtcctgggcccagtctgccctgactcagcctgactccgtgtctgggtctcctggacagtcatcactatctcctgcactggcaccagcagtgacagtaggtncttaataactatgtctcctagtaaccaacaacaccagccacgccccagactcatctatttctgatgtcagtgacgtcgtccgtttggactttctaatcgtcttcgtctcgtcctacgtaacgtcgtaggaccaaacgtcggtccctttcccgtacgaaccctaacgtccgtcccgggtctacccgacgcgtaggaacggacgaggtcctactaactttaactcgtagactacgtctacaattaacaaccgacccggtagggaccctaacgttccgtagtaccgtaagttcgggttaccggggaccgtaacggggtaccctcggggccttacgggtaccccttaccgtaaccggtccgtaacccgcccggtaaacccgg

SEQ ID NO: 176603 - DNA, 676 bp, Homo sapiens
  misc_feature: GYAE6OF01BKH4S.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccaccagcagtgacataggtgcttataactatgtctctgtaccaacaacaccagccacgccccagactcatctatttctgtatgtacagtgtacgtccggtcccgtttgggtactttactaacttcgtctttcctcttcgtcccttccgaagtcctcggacctaacgaccggtcctttacccctacgaaccctacgtccgtcccggggcccttcccgaaccgtccgtacggaacgggaccggtaaggtccttacgtaactttaacgtttaacctcgtacgtacgtaccttacctacgttaaccttaaccgaaccccggtaggggaccctaacgttccgtaccggttagtaacgttacggttccgggacgggtaacggggtcccgttacgggcccgttaccggtaccccgttacccggttaccggtacccgacccggtccccggtaaacccggg

SEQ ID NO: 176604 - DNA, 577 bp, Homo sapiens
  misc_feature: GYAE6OF01EIXXJ.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcatttctgatgtctagtgacgtcggtccctttgggtactttctaatcgtcttctctcgcctcacgtctggacacacggtcttcccgtagtaccatccgtccgggcctccacgtcgtcgacggacgcgctctatttacttactgctagctactataactaccaccgacgggacctacgttctcgttacgtagttacgttccgggcgggtaacgggtcccgtagggtcccgttaccggtacccggttacccttaccggtaccgaccgtcccgtaaaccggg

SEQ ID NO: 176605 - DNA, 632 bp, Homo sapiens
  misc_feature: GYAE6OF01AJYX7.10.72.G06.1.454.CMB.1.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (376)..(376): a, c, t, g, unknown or other
  misc_feature (376)..(376): n is a, c, g, or t
tcagcatagtagtgcacgaccggtgctcgatttagctacgactgcaaggggaaagggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggactagtcgatcactatctcctgacacgtggccaccagcagtgacataggtncttaanactntgtctctggtaccaacaacaccaggccacggccccagacctcactctatttctagtactgtacagtcgtacgttccggtcccgtttggtactttactaacgttctccgttactcgtcnccttacctagtctacggactaaccgcggttacctccctagtaccctcgttcccgccggtcctaccgcgtccgtacggacgggaccgacgtccgtactaatttacttcgcgtcgacgtctactactaactaccggacccgtacgggtacctacgttccgtagtacgtaccgttacgggttcccgggacgggtacggtccgtaccggtcgttacccggacctttacccggtaccggacctaccggacccgtacccggg

SEQ ID NO: 176606 - DNA, 575 bp, Homo sapiens
  misc_feature: GYAE6OF01C5LTF.10.72.G06.1.454.CMB.1.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacaggtcctgggccctgtctgccctgactcagcctgcctccgtgtctgggtctcctggacagtcggtcaccatctcctgcactggacccagcactgatgtggcattataaccttgtctcctggtatcaacaacgcccagacaaacgcccccanactcttgatttangaagtcagtaagcggccctcgagggttctagtcgcttctctcgcctcaagtctggcaacncggtcctcctgacaatctacgtgggctccgaggctgacgacgaggctagaattatactgcanctanatactgtanagtggtctacctttcgtttcgtaacgggttttccggacgggtacgggtaccgagggtccttacggaacccgttacgtaaacggtccaaccggtaccctaaacgggtcccgtacccggtccccccgttgggttaccccg

SEQ ID NO: 176607 - DNA, 724 bp, Homo sapiens
  misc_feature: GYAE6OF01A81ZF.10.72.G06.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
tcagcatagtagtgcacgaccggtgctcgatttagctacgactgcaagggaaagggggggtctcgaggaggcagcgctctcaggacgtcaccaccatcggcctgggctctgctcctcctcaccctctccactcaggcacgaggtcctgggcccagtctcgccctgactcacgcctcccgccgcggtccggtctccgtggacngtcacgtcacatcctctgcacgtcgaaccngcagtatactttgtcgcttaanaactatcgtcttcgtcggactacgcaccaccaggaccaaaccgacccctaacttccgtttagttttagacgtacaagtacgcggaccctagacgtcgtacccgtgtacgttcgttctcacgtccgtaccgtaagtcgtacggtaaccaaaccgtccggttaccctacccgtacgtacccgtccgttacggttccgggtacctccggtacgggtacgtacgggtaacggtacgggttagacggtaaccgttggtaaacttaccgtaacggtcgtaaccgcggtacctacctaagttacccgtaacggaacccggtaccccgttaaggacgggttttccgggtacgggaccggtacggggtaacctaagggttcgacccggttcggtacgggtaccgccggtaacgtccggtacgtcccgtaccccgtcggttccaccgtttcccggtacttccccccggtccttaaccccg

SEQ ID NO: 176608 - DNA, 760 bp, Homo sapiens
  misc_feature: GYAE6OF01AZX2K.10.72.G06.1.454.CMB.1.raw
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatccactatctcctgcacgtggccaccagcagtcgacagtaggtgtacttaataactagtcgtctcctacggtaaccaacaacacccgaggcccacggcccccagacctcatctntttcngatntcagtgtacgtccggtccgtttggactttactactcgtaccttcgtcctcgtccctacgtaacgttcgtacgggacctaaaccgtccggttccctttaccccgtacgtaacccctacgttaccccggttcccggggtacccttaccccggtaacggtaccgtacgggtaaccgggaaccgggttacgggtacccttacgttaacgtttttacgttaaccgtcgtaccggtaccggttaaccttacgaaacgtttaacccgtaaccggtaaccccgggaacggggttccctaacccgtttcccggttacggtacggttaacggtttacggggttacccggggaacggggttaccgggttacccgtcgggtaacccgttcccggtaaccccggtttcccgtaaccggtcccgtaaccgtccccgggttaaacccgg

SEQ ID NO: 176609 - DNA, 628 bp, Homo sapiens
  misc_feature: GYAE6OF01C7XN7.10.72.G06.1.454.CMB.1.raw
  modified_base (212)..(212): a, c, t, g, unknown or other
  misc_feature (212)..(212): n is a, c, g, or t
  modified_base (303)..(303): a, c, t, g, unknown or other
  misc_feature (303)..(303): n is a, c, g, or t
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactanctcctgcactggccaccagcagtcacagtaggtgcttataactatcgtctcctaggtaccaacaacacccaggccacggacccccagaccnctatactattctgatgtctagtgtacgtcggtccgtttggtactttactaactcgtctttctctcgtccttaccaacgttccgtggaccaaccgtaccgtccgttaccccgtacgtaccctacgttacccgtcccgggtccctcccgaccgtcctaggaacgggtacgacgtacctacttaagtttactacgtcgtcgacgtctactaactactaaccaccggtacgggactacgtcgtcgtacgtatacggtccgggaggtaccgggtccgtaggtccgtaccggtacccgttaccgtaccgtaccgaccgtcccgtaaccggg

SEQ ID NO: 176610 - DNA, 577 bp, Homo sapiens
  misc_feature: GYAE6OF01ARG2W.10.72.G06.1.454.CMB.1.raw
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatctatttcngatgtcagtnagtccggtcctttggtatttctaatcgcttctctcgcctcagtctggacaacgacggtccttccctagacctagtccgtccgggtacctccgacgtctacggacggacgaggcctacgtaatttacttaacgtgactagccgtacaatacgtaacccacccggacgggacaactcgtacgttagtattacggttcgggacgggtacgggtacctgggcctacggtacccgttacctacggtacgaccgtacccgtaaccgg

SEQ ID NO: 176611 - DNA, 706 bp, Homo sapiens
  misc_feature: GYAE6OF01EM4LK.10.72.G06.1.454.CMB.1.raw
  modified_base (377)..(377): a, c, t, g, unknown or other
  misc_feature (377)..(377): n is a, c, g, or t
  modified_base (518)..(518): a, c, t, g, unknown or other
  misc_feature (518)..(518): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcgagggcacgagggtcctgggcccagtctcgccctgactcacgcctgactccgtgtcgtgggtctccgtggacagtcgatcactatcctcctgccacgtgccaccgagacagtgactagtaggtcgttacttaataacttcgttcggtaccttccgtacggtaacccaaaccaaccgacccgacggccccgaacccggcccccctaagaccttacacttacttactttccgtacgtacgttgtacnggtacgtaccgttccggttaacccgtttggtaactttctaacgtcgttcgttacctcgtaccgtcctacggtacttcgtacggaacctaaccgtcgttccttccgtacgtaccctcgtcccgtaccggtaccctccggacncggtacggaccgtacgacgtactacttacgttacgtaccgtgacgtctaccttacgacttaaccgtaaccgacccgggtaggaccctacgtcgttacggtagtacgttcgggtcggtacggggccggtaccggtctcggttacccggttacctaccgtaccgtacccgaaccggtcccgtaaaccggg

SEQ ID NO: 176612 - DNA, 791 bp, Homo sapiens
  misc_feature: GYAE6OF01B0M82.10.72.G06.1.454.CMB.1.raw
tcagcatagtagtgcacgaccggtgctcgatttagctacgactgcaaggggaaaggggggggtctcaggaggcagcgctcgtcgggacgtctccaccatggcctgggctctgctattcctcaccctcctcactcgagggcacagggtcctgggcccagtctcgccctgactcagcctgactcgtgtcgtggtcctccgtggactagtcgatccactatcctcctgacctacgtcggccaccgagctagtacgactagtaggtctacttaataacttatcgttcctaccgtacgtaaccaacaaccacccgacggcccgacccggacccccagtaccctacgtacttaccgttacttttcgagtacttacgtaccgtaggttcgtaccggttccgggttacccgtttagggttaccttttacgtaacgttccgttacctttcctccgttacgtaccctaacgtacggtccgtaccggtaccctaaaccggtcccggtttacccttacccgtaccgtacccgttaccgttccccgggtacccgtacccctaccgtaaccggtcggtaacgggaaccggtaacgggtccgttaccgtttaacgttacgttttaaaccgttcgtaacgtaccgtacctaccgttaacgtaaccgttaaccgacccgtacccgggtacggaccctacgttccgtacggtagttacgtacgggttccgggacggtaccgggttcgaccggtccggttaacccggtacccgttaccggtaaccgtccgaaccggtacccggtacccgg

SEQ ID NO: 176613 - DNA, 654 bp, Homo sapiens
  misc_feature: GYAE6OF01AUAFE.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacatcggggatcactatctcctgcactggcaccagcagtgacataggtgcttataactatgtctcctcggtaaccaacaacacccgacggaccgacggcccccagacctcactcctatttcgtgtatgtcaggtgtacgtcggtccttgggtactttctaagtctcttctctcgtcctacgaacgtcgtacggactaacaccgggtccttcccgtacgtaccctacgtccccggtttcccgggacccttcccgtaacgccgttacggacgtacggaacggtcctacggtactttaagttacgtcgactaacgtcctactaattaacctacccgaaccgtacgggacctacgttcgacggttataacgttacggttccggggaggtaccgggtcccgttaggtccctacgggttaaccccgttcccgtaaccggaccctacgtaccccggtaacccggg

SEQ ID NO: 176614 - DNA, 669 bp, Homo sapiens
  misc_feature: GYAE6OF01B5UYP.10.72.G06.1.454.CMB.1.raw
  modified_base (331)..(331): a, c, t, g, unknown or other
  misc_feature (331)..(331): n is a, c, g, or t
  modified_base (384)..(384): a, c, t, g, unknown or other
  misc_feature (384)..(384): n is a, c, g, or t
tcagcatagtagtgcacgaccggtgctcgatttagctacgactgcaagggaaaggggggggtctcgaggaggcagcgctcgtcgggacgtctccaccatggcctgggctctgctattcctcaccctcctcactcagggcacgagggtcctgggcccagtcctgccctgactcagcctgactcgtgtcgtgggtctccgtggactagtcatcactatctcctgcacgtcgacacgagctagtagactagtaggtctattaatactatcgtactaccgtacgtaacaaccacgacccgaggcccacggaccccagacctcacttcgtattcgngtatcgcgaggtcgacgtccggttccgttggtactttcgtactcgtcttctcncgtacctgactgtacgacaacggcgtacctccgacgacctacgtccgcggtaccaccgcgtcgacgacggcgacgtccttagtaactttgtacctaccggactacgttaccctatacgttactaggtacgtaacggtttcgggtaccgttaccgttttaccgggttaaacggtttaccgggggtttaccgggaccggggttaaccggacggttaacccgggccgtttaaaccgggaccccgttaacgtacggaacccgtccggtaaccggtcccgttcccccggg

SEQ ID NO: 176615 - DNA, 643 bp, Homo sapiens
  misc_feature: GYAE6OF01B0SRY.10.72.G06.1.454.CMB.1.raw
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacaggtcctgggcccagtctgccctgactcagcctgactccgtgtctgggtctctggacagtcgatcactatctctacgcactggacaccagctagtgtacttttgtgacttataactatcgtctctggtacagcaccaccaggcaaacgacccctaactccttagttttgaagtcagtaacgcggtcctcgaggtcgtcctgtatcgttctctcgtccctacaagtctacggacaacgtacggtccctaccctcggaccgtctacgtcggcgtcgacgctaggaggtagtgacgacgttacgacttactacgtcgtactacgcgcctaagtacgtaccgtaccggaacccttaacggtacggggttaggtttcgggacggggttaccgggtaacgttaacgggtccggttaccggtaccggtgggttaccgacggacccggttaacgggccgtttacccggcccccggttcggtacccgtccttccggttcccgttaccccccg

SEQ ID NO: 176616 - DNA, 859 bp, Homo sapiens
  misc_feature: GYAE6OF01AR9Z6.10.72.G06.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (400)..(400): a, c, t, g, unknown or other
  misc_feature (400)..(400): n is a, c, g, or t
tcagcatagtagtgcacgaccggtgctcgatttagctacgactgcaaggggaaaggggggggtctcaggaggcagcgctctcgggacgtctccaccgtggcctgggctctgctattcctcaccctcctcactcagggcacagggtcctgggcccagtctgccctgactcagcctgactcgtgtctggtctctggacagtcgatcactatcctcctgcactggcaccngcagtnacagtaggtntacttaataactagtcgtcctccgtacggtaaccaaaccaaccacccgacggcccgaccggacccccagacctcactactacgtttcgtagtatcgtacgtagtagtacgttccggttaccgtttgggttactttacgtactcgtcttcctacgtcnccctactaacgtcgtacggactaaccgacggtccttacccgtacgtaccctaaccgttccccgtcccgggtaccttaccccggaccggttaccggtacgggtaacgggtaaccggtacggtacccgttacttaaacgtttaacgtttaaccgtacggtacccttaaccggttacccttaacccgtaaacgttttaaaccccgttaaacccccggaaccccggggtttaaaccgggggtaccccttacccggttaaccggtttacccggttaggttaaaccgggtttaacccggggttccgggggtaacccgggggtaaccgggggttaaccccggttccgggttaacccccggtttaccccgggtttaaacccccggtttaaccccggggtttaacccgggtaaccccggtaaacccccggggttaaccccggggtaaacccgggtttcccccccgggg

SEQ ID NO: 176617 - DNA, 682 bp, Homo sapiens
  misc_feature: GYAE6OF01CZLXW.10.72.G06.1.454.CMB.1.raw
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
tcagcatagtagtgcacgaccggtgctcgatttagctacgactgcaagggaaaggggggggtctcaggaggcagcgctctcgggacgtctccaccatggcctgggctctgctgctcctcaccctcctcactcaggacacagggtcctgggccctgtctgccctgactcagcctgcctcgtgtctgggtctcctggacagtcgtcacctatctcctagcacgtcggacccagcactgagtgtggctattaactaccgttcgtctccttaggtactaccgaacctaccgcccaaacgaaccaaccgaccccacgtaccttactgtatttagacgtaagtacgagtaacgccggtaccctggtacgggtttcacgttccgtctttctccgtcgcccttaacctaacggttcgtacggtaaccaaccgtaccgttccctacccgtagaaccttacgttccgtaccggtcgggtaccctaccgtaggtcccgttacgggaaccgtacgggtacgtcgtaagtaacttacgtaacngtaccntaacctnaagttagtagtaggtgttacgttctcgtttacgttacgggtttaaccgggtcgggacggtagtacccgtggttaaccgtccgttaacgtaccctaagggtcccaccggacccgtaggtcccacccggttcccgtacccg

SEQ ID NO: 176618 - DNA, 532 bp, Homo sapiens
  misc_feature: GYAE6OF02GFDO0.10.72.G06.1.454.CMB.1.raw
  modified_base (440)..(440): a, c, t, g, unknown or other
  misc_feature (440)..(440): n is a, c, g, or t
tcagcatagtagtgcacgaccggtgctcgatttagctacgactgcaagggaaaggggggtctcaggaggcagcgctctcgggacgtctccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggcctcaggagtccctgatcggttctctgcctcaagtctggcaacacggcctccctgaccgtctcgtcgggctccaggctgaggatgaggctgattacactgcagcgcatattcaggcccaagngggtgtttggcggcgggactaaggtgaccgtcgtgggtccaggcccaaggcctcgccccctggtccactcctcgttccccaccctcctaccc

SEQ ID NO: 176619 - DNA, 499 bp, Homo sapiens
  misc_feature: GYAE6OF02GV0CS.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccagggcactctcgtgatagttcggcggagggacctggctgaccgtcctacgtcacgcccaacgg

SEQ ID NO: 176620 - DNA, 548 bp, Homo sapiens
  misc_feature: GYAE6OF02IW1QW.10.72.G06.1.454.CMB.1.raw
  modified_base (429)..(429): a, c, t, g, unknown or other
  misc_feature (429)..(429): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggaaccagcagtgactttgtgcttataactatgtctcctggtaccagcaccaccaggcaaagccccaaactccttgttttgaggttcagtaagcggccctcaggagtccctgactcggttctctgcctccaagtctggcaacacggcctccctgacccgtctctgggctccaggctgaggatgaggctgattactactgcagcgcaatnttcacggccccaagtagggttgtttcgggcggtcgggaactagggtcgaccgtccgtgggtccacggcccgaaggcctcgcccccgttggtcccaccgtccgttcgttccccgtccccg

SEQ ID NO: 176621 - DNA, 565 bp, Homo sapiens
  misc_feature: GYAE6OF02F54S2.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccagcaccacccaggcaaacgcccccaaactccttgttttgagtcagtaacgcggccctcgaggacgtccctgatcggttctctgcctcaagtctggacaacgaccggccctcccgtcgaccgtctcgtcgggcctccgaggctgaggattggaggctagtacttactactgcagcgctatacttcgacgcccaagtagggtcgttcgggcggacgggtactagggtcgaccggttccgtagggtaccacggacccgtaaggccgtccggtccccctcggtcctaccgttccgttcccgg

SEQ ID NO: 176622 - DNA, 527 bp, Homo sapiens
  misc_feature: GYAE6OF02IBAPB.10.72.G06.1.454.CMB.1.raw
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagcatagtagtgcacgaccggtgctcgatttagctacgactgcaagggaaagggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccaggccagccccagactcatcatttctgatgtcagtgatcggcctttgggatttctaatcgcttctctgcctccaagtctggcaacacgcttcctgaccatctccgggctcactcgngagacgagctntattatactcgcatctacatactaaccaccgacgggactactcgtcgtagtacgtacgttcgggacggaacgggtaccgtcggtacgtaccggtacccgtaccgttacgtccgacgacccgaacgg

SEQ ID NO: 176623 - DNA, 674 bp, Homo sapiens
  misc_feature: GYAE6OF02IY3ST.10.72.G06.1.454.CMB.1.raw
  modified_base (301)..(301): a, c, t, g, unknown or other
  misc_feature (301)..(301): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctctgtaccaacaacaccagccacgccccagactcatctatttcngatgtcagtgatcggtcctttggatttctaatcgtcttctctcgtcctacctaagtccgtcggtacctaaaccgtaccgggtccctttccccgtacgtaacccgtaacgttcccgttcccggggtccctacccgtaaccggtccgttacggaaccgggtaaccggtacggtaccttactaactttaacgtttaccgtacggtacgtacgtcctacgtaacttactaacccgaacccggtaacgggacctaaccgttccgtccgttacgtaacgttacggttaccggggaccgggtacggggtacccgttcgggtaccgttaccggtacccgttacccgttaacccggttaccgacccgtaccccgtaaccggg

SEQ ID NO: 176624 - DNA, 507 bp, Homo sapiens
  misc_feature: GYAE6OF02JAIRD.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtccgggtctcctggacagtcgatcactatctcctgcactggcaccagcagtgactttgtgcttataactatgtctcctggtaccagcaccacccaggccaggcccccagactcatcatttctgatgtcagtgatcggccctttgggatttctaatcgcttctctgcctcaagtctggcaacacgcttccctgaccatctccgggctccacgctgacggacgaggctctattacttactgcagctcatactaccaccagggcactctcgtgatagtcggcggaggaccgtggcctggacccgttcctacgtcgacgcccaggtcccg

SEQ ID NO: 176625 - DNA, 501 bp, Homo sapiens
  misc_feature: GYAE6OF02HP3V2.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacgctcctgaccatctccgggctccacgctgaggacgagctctattattactgcagctcatactacacccgagggcactctcgtgattagtcggcggacgggacctggctcgaccgtccgtacgtcacgccctaacgg

SEQ ID NO: 176626 - DNA, 521 bp, Homo sapiens
  misc_feature: GYAE6OF02IN14B.10.72.G06.1.454.CMB.1.raw
  modified_base (411)..(411): a, c, t, g, unknown or other
  misc_feature (411)..(411): n is a, c, g, or t
  modified_base (426)..(427): a, c, t, g, unknown or other
  misc_feature (426)..(427): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggtcctttgggatttctaatcgtcttctctcgtcctcaagtctggcaacacggtcttcccgtgaccatcgtccgggctccacgctagaggacgnggctctattattacnncagctcatataccaccgagggccactctcgtagatacgttcgggacggacgggtccgtcggctcggaccgttccgtacgtcacggccctaacgg

SEQ ID NO: 176627 - DNA, 538 bp, Homo sapiens
  misc_feature: GYAE6OF02IKDFO.10.72.G06.1.454.CMB.1.raw
  modified_base (378)..(378): a, c, t, g, unknown or other
  misc_feature (378)..(378): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactggcaccagcagtgacataggtgcttataactatgtctcctggtaccaacaacacccaggccacggcccccagacctcatcatttctgatgtcagtgactcggtcctttgggatttctaattcgcttctctgcctcaagtctggcacacggtcttcctnaccatcgtccggctccacgctggacggacgaggctctattacttactgcagctcatactaccacccgacggggcaccgtctcgtgtacgttacgttcgggacgggtacgggaccgttcgggcgtcggaccgttccgtaccggtcgaccgtcccgtaacgg

SEQ ID NO: 176628 - DNA, 499 bp, Homo sapiens
  misc_feature: GYAE6OF02I13DX.10.72.G06.1.454.CMB.1.raw
tcagcatagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacgcttccctgaccatctccgggctccacgctgaggacgagctcattatactgcagctcatatacacccagggcactctcgtgatagttcggcggagggacctggcctcggaccgtcctacgtcacgcccgtaacgg

SEQ ID NO: 176629 - DNA, 493 bp, Homo sapiens
  misc_feature: GYAE6OF02G9I3H.10.72.G06.1.454.CMB.1.raw
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagacctcatcatttctgatgtcagtgatcggcctcgagggtttctaatcgcttctctggctcaagtctggcaacacggcctccctgaccatctctcggctccgagctgaggacgaggctgattatactgcagctcaatataccaactagcagcacttctagtgtcggcggagggaccagctgaccgtcgtacggtcacgacccg

SEQ ID NO: 176630 - DNA, 570 bp, Homo sapiens
  misc_feature: GYAE6OF02I975I.10.72.G06.1.454.CMB.1.raw
  modified_base (322)..(322): a, c, t, g, unknown or other
  misc_feature (322)..(322): n is a, c, g, or t
tcagcatagtagtgcacgaccggtgctcgatttagctacgactgcaagggaaagggggggtctcaggaggcagcgctctcgggacgtctccaccatggccttggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccagcaccacccaggcaaagcccccaaactccttgttttgagtcagtaagcggccctnaggagtccctgatcggttctctgcctcaagtctggcaacacggcctccctgaccgtctctgggcctccaggctgaggactgaggctgattactactgcacgcgccattacttcgacgggccccaagtggggttagtttcgggaccgggcgggtacctaagggttcgacccggttccggttagggtccacggtccccgaagggcccttacgggcccccccttgggtaccctaccgttcccgttccccgg

SEQ ID NO: 176631 - DNA, 712 bp, Homo sapiens
  misc_feature: GYAE6OF02J2WYD.10.72.G06.1.454.CMB.1.raw
  modified_base (199)..(199): a, c, t, g, unknown or other
  misc_feature (199)..(199): n is a, c, g, or t
tcagcatagtagtgcacgaccggtgctcgatttagctacgactgcaagggaaagggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacngtcgatcactatctcctgcactggcaccagcagtgacagtagtgacttatactatgtctctacgtaccaacaccaccacgccacgccccagctacatctattactgatgtcagtgtacgtccggtccgtttggtactttctaacgtccgtctttcctctcgtacctaccgtaacgtccgtacggcctaaccgtaccggttcccttccgtacgaccctacttcccggtcccgggtcctacccgaccgtacgtacgggaacggtaccggtacggtaccttaccttaacttaacgtttaccgtcggaaccttacggtaccttaccgtaacgttaaccgtaacccgttaacccgggaacgggtccctaacgtaccgttaggtacgtaacggtttaccggtaccggggtaccgggaccggggttaacccggttagggttaccccgtaacccggttaaccccggggtttccccgttaaacccggtccccggtaacccggaaccccggtttaaccccggg

SEQ ID NO: 176632 - DNA, 525 bp, Homo sapiens
  misc_feature: GYAE6OF02G6MW8.10.72.G06.1.454.CMB.1.raw
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggccccagactcatcatttctgatgtcagtgactcggtcctttgggactttctaactcgtcttctctcgcctctaagtctggcaacacgtcttcctgaccatcctccgggctccgacgctgacggacgagctcattattactgcanctcatataccaccgngggacnctcgtcgtgattacgttcgggcggacgggaccgtggtcgtcggtacccgtcctacggtccaccgccctaacggg

SEQ ID NO: 176633 - DNA, 557 bp, Homo sapiens
  misc_feature: GYAE6OF02I4DLM.10.72.G06.1.454.CMB.1.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (416)..(416): a, c, t, g, unknown or other
  misc_feature (416)..(416): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccaccagcagtgacagtaggngcttataactatgtctcctggtaccaacaacacccagccacgccccagactcatcatttcnatgtcagtgactcggtcccgtttggtatttctaagtcgtcttctctcgcctcaagtctgcaacgacgtctccctcgacctactccgtccggcctccacgtctggacgacgngctctattactactgtcagtcctactactactacccgaccgagggcctaccgtcgtcgtagtacttacggtcgggaccggacgggtacccgtcggtaccgtcggtacccgttcccgttaacggtccaccgcccgtaaccgg

SEQ ID NO: 176634 - DNA, 563 bp, Homo sapiens
  misc_feature: GYAE6OF02JFAAG.10.72.G06.1.454.CMB.1.raw
  modified_base (369)..(369): a, c, t, g, unknown or other
  misc_feature (369)..(369): n is a, c, g, or t
  modified_base (410)..(410): a, c, t, g, unknown or other
  misc_feature (410)..(410): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggaaccagcagtgatgttggtggttatgtactttgtctcctggtaccaacagcagccaggcgaacgcccccaaattcatgatttatgatgtcagtgcgcggcccgtcggggtccctgactcgcttcgtctcggctcagtctcggcaacnccggcctccctgaccatctcgtggccctcacgcctgacggntgagtctgatttactacttgttgctactatagtcgacgtacgggtccgtaccgtgttgggttcggtcgggacgggtaacgggaccgaacggtccgttaccggtacccgttccggtacggtccgaccggtacccgtaacgggtccctccccggg

SEQ ID NO: 176635 - DNA, 667 bp, Homo sapiens
  misc_feature: GYAE6OF02H6CCK.10.72.G06.1.454.CMB.1.raw
  modified_base (310)..(310): a, c, t, g, unknown or other
  misc_feature (310)..(310): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactggcaccagcagtgacataggtgcttataactatgtctcctggtaaccaacaaccacccaggcccacggcccccagacctcatctatttcngatgtcagtgatccggtcctttggtctttactaagttcgtcttctctcgtccctacgtaagttccgtggaccaacgtaccggttcctttacccgtacggtaccctacgttcccgtcccgggtccttacccgaccgtcgttaggaacgggtacgacggtaccttacgtaatttaacttacgtcgtcgaacgtccttacctaacttaacctaacccgtacccgacggggtacctaaccgttccgttacgtacggtaacgttacggttccggggaccgggtaacggggtacccgttcggaccgttaccggtacccggttacccgttaaccggttaccgaccggtacccccgtaaccgggg

SEQ ID NO: 176636 - DNA, 613 bp, Homo sapiens
  misc_feature: GYAE6OF02GVLNT.10.72.G06.1.454.CMB.1.raw
  modified_base (257)..(257): a, c, t, g, unknown or other
  misc_feature (257)..(257): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcactggcaccagcagtgacataggtgtacttaataactatntctctagtaccaacaaccaccacggccacggccccagacctcactctatttctgtatgtcagtgtacgtccggtccgtttgggtactttactaacgttccgtcttcttctcgtcctacctaacgtcgtacggacctaaccgtaccgtccttcccgtacgtacctacgttccgtacccggcctccgtacgtcgtacggacgtacggacgtcctactattactactcgctacgtcctactactaccgtaccgaccgtacggactacgtcgtcgtagtacgttacggtcgggacgggtacgggtaccgtcggtaccgtacgtacccgttaccgtacggtaccgacgtacccgtaaccgg

SEQ ID NO: 176637 - DNA, 561 bp, Homo sapiens
  misc_feature: GYAE6OF02I8LHL.10.72.G06.1.454.CMB.1.raw
  modified_base (388)..(388): a, c, t, g, unknown or other
  misc_feature (388)..(388): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggccaccagcagtgacataggtgcttataactatgtctcctggtaccaacaacacccaggcccacggcccccagactcatcatttctgatgtcagtgagtcggtccgtttggtatttactaatcgtcttctctcgcctcaagtctgacacgacgtcttcctcgaccnctcgtcccggctcccgacgtcgtgacggacgtaggtctctattactacgtgctagctactatactaccaccgacgggacctacgtcgttcgtagtagttacgttccgggacggtacgggtaccgtcggccgttcggtacccgttccgtaccgtccgaccgtcccgtaaccggg

SEQ ID NO: 176638 - DNA, 733 bp, Homo sapiens
  misc_feature: GYAE6OF02ISPE9.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctctgcacgtggcacagcagtgacataggtgcttataactatgtctccgtggtaccaaacaaccaccaggccacggcccccagacctcatccgtactttctgacttgtcagtgtactcggcccgtttgggactttctaatcgtcttactcttcgtcctacgtaagtcgtacgctaacgacggtcctttccctcgaccctagttcccgtaccgggcccttccgaccgtcgtacggtacgggaaccggtacggtacccttcgttaactttaaccgtttctaccggtaccgaacggtcccttacgtaacgttaaaccgtacccggtaaaccccggtagggggtaaccctaaccgtttacccgttaccgggtttacgtaacggttttaccggttaacccggggggtacccggggtaacgggggttaaccccgttacgggggtcccgtttacccggggaaccccgtttaaccccggtttaccccgggttaacccgggtaccgggtaccccccggttaaacccggggg

SEQ ID NO: 176639 - DNA, 513 bp, Homo sapiens
  misc_feature: GYAE6OF02FHETN.10.72.G06.1.454.CMB.1.raw
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggcctttgggatttcaatcgcttcnctgcctcaagtctggcaacncgcttcctgaccatcctccgggctccacgctcgaggacgaggctcattattactgcngctcatactaccacccgagggccactctcgtgatagttcggcgggagggtaccctggtctcggacccgttcctaccgtcgacgacccgaacgg

SEQ ID NO: 176640 - DNA, 533 bp, Homo sapiens
  misc_feature: GYAE6OF02JCD4G.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttccctgacctatccgtccgggcctccacgctgacggacgaggctacattatactgcagcctacatactaccacccgagggctactctcgtgtaatcgttccgggacggacgggtaccgtggtccgtcggtaccgtcccgttacggtcaccggtaccctaacgg

SEQ ID NO: 176641 - DNA, 547 bp, Homo sapiens
  misc_feature: GYAE6OF02GRZE9.10.72.G06.1.454.CMB.1.raw
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
tcagcatagtagtgcacgaccggtgctcgatttagctacgactgcaagggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccnggccaggcccccagactcatcatttctgatgtcagtnatcggtcctttggatttctaatcgcttctctgcctaccaagtctgacaacacggcttcctgaccntcctccgggctccacgtctcgacggacgnggctactattactactacgcacgctacgattacaccaccgagggcctacgtctccgtnacttacgttcgggcggtacgggtacccgtgggtacttcggtacccgttcccgtaccggtaccgacgaccccgtaaccgg

SEQ ID NO: 176642 - DNA, 665 bp, Homo sapiens
  misc_feature: GYAE6OF02JNLCA.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtcctgccctgactcagcctgactccgtgtctgggtctcctggacagtcgatcactatctcctgcactggcaccagcagtgacataggtgcttataactatgtctcctggtaccaacaacaccacggccacggccccagacctcatcattctgatgtcagtgatcggtccttggtatttctaatcgtcttctcgtctcctactagtctcgactaccgacgtccttccgtcgtacctagttccgtacccgggtcctacccgacgccggttacggaacggaccggtacgtaccgttactaactttaacgtttaccgtacgtaccacgttcctaccttaacgttaaccgtaacccgtaacccggtacggggacccttaaccgtaccgtttaccgttacgttaacgtttaaccggttccggggaccggtaccggggttacccgtacgggtacccgttaccggttacccgttacccggttaacccggtaccggtcccggtaaccccgtaacccggg

SEQ ID NO: 176643 - DNA, 589 bp, Homo sapiens
  misc_feature: GYAE6OF02H4XDI.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctgctcctcaccctcctcactcaggacacagggtcctgggccctgtctgccctgactcagcctgcctccgtgtctgggtctctggacagtcggtcaccatctcctgcactggacccagcactgatgttggcattactaaccttgtctcctggtatcaacacgccagacaaacgcccacactcttgatttatgaagtcagtaagcggcctacgtaggggtttcagtcgtcttctctgcctccaagtctacggactaacgtaccggtccttccctagaaccctacgtccgtacccgggcctaccgaccgtcgtacgaaggacgaggtctactattacttactagctacgctacatactaccaccgagggacctacgtctcgtagtatacgtcggacggtacggtaccgtggccgtcggtacccgttaccgtaccgttacgaccggtacccgtaacggtcctacccggtccccgttacccgg

SEQ ID NO: 176644 - DNA, 624 bp, Homo sapiens
  misc_feature: GYAE6OF02ISF26.10.72.G06.1.454.CMB.1.raw
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
  modified_base (475)..(475): a, c, t, g, unknown or other
  misc_feature (475)..(475): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacgagggtcctgggcccagtctgccctgactcagcctgactccgtgtctgggtctcctggacagtcgatcactatctctgctactggcaccagcagtgacagtaggtgcttataactatgtcctcctaggtaaccaacaaccaccaggccacggcccccaagacctcactctatttctnagtgtcagtgtacgtcggtccgtttggactttactaagtccgtcttctctcgcctacaacgtctcgacaacctcggtcctttaccncgtaacctactcccgtacccgggctaccgtacgtcgtcgacggtacggacggtctacgttaattacgttacgngtactagtaccttacacttaacgtacccgaccggacgggtacctacgtcgtacgttacgtagtttaccggttcgggacggggtacggtacccgttggaccgttaccggaccgtttcccgaacggttccgaacccggtacccgtaccggg

SEQ ID NO: 176645 - DNA, 709 bp, Homo sapiens
  misc_feature: GYAE6OF02G3OGE.10.72.G06.1.454.CMB.1.raw
  modified_base (142)..(142): a, c, t, g, unknown or other
  misc_feature (142)..(142): n is a, c, g, or t
tcagcatagtagtgcacgaccggtgctcgatttagctacgactgcaaggggaaaggggggggtctcaggaggcagcgctctcgggacgtctccaccatggcctgggctctgctatttcctcaccctcctcactcagggcacngggtcctgggcccagtctgccctgactcagcctgactccgtgtctgggtctcgtggacagtcgatcactatctcctgcactggcaccagcagtgacagtaggtgtacttaataactatgtcctcctaggtaaccaaacaaccacccaggacccgacggcccccagacctcactctaatttctgatgtcagtgtacgttccggtccgtttagggtacttttacgaacttcgtctttctctacgcctacgtaacgtcgtacggacctaaacgcccggtccttaccctcgacctacgtccgtacccgggtctaccgaccgtcggttacggaacgggtacgacggtcctacgttaagtttacttaccgtggacctggtaccttacgtaacttaaccgtaacccgtaaccccgggtacggggtacccttaaccgttccgttaacggtagttaaccgttacgggtttcccggggaaccggggtaaccgggtacccggttaccgggtaccgtaccggttacccccgggttacccgttaacgggtaccccggtaccggacccccgttaacccggg

SEQ ID NO: 176646 - DNA, 671 bp, Homo sapiens
  misc_feature: GYAE6OF02GEV2V.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacatacggtgcttataactatgtctctggtaccaacaacacccaggcccaggccccagactcgatcactttctgatgtcagtgactcggtccgtttgggacttttcgtaatcgtctttctcgtcgtcctacctaagtctcgggctaaccgtaccggcctttccctcgtacctacgtcccgtcccgggtaccttcccgaccggtccgtaggaaccgggtacggaacgggtccttacctacgtttaacttaccgttcgtacctacgtaccgtacctaactttaacgtaacccgtaaccccgtaacgggggtacctaaccggttccgttaccggtagtacgttacggttaccgggtaccggggtaccgggtaccgtacgggtaccgttacggtacccggttacccgttacccggtacgacccggtaccccgtaacccggg

SEQ ID NO: 176647 - DNA, 512 bp, Homo sapiens
  misc_feature: GYAE6OF02FVAFY.10.72.G06.1.454.CMB.1.raw
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacacacccaggccaggcccccagactcatcatttctgatgtcagtgatcggcctttggggatttctaatcgcttctctcgcctcagtctgcacncgctcctgaccatctccggctccgacgctcgaggacgnggctcattatactgcagtctcgatanacacccgagggcacgttcctcgtgattagttccgggcggacgggtcctggtctcggacccgtccgtacgtctacgacccgtaacgg

SEQ ID NO: 176648 - DNA, 542 bp, Homo sapiens
  misc_feature: GYAE6OF02FJNU4.10.72.G06.1.454.CMB.1.raw
  modified_base (244)..(244): a, c, t, g, unknown or other
  misc_feature (244)..(244): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcacgtggcaccagcagtgacataggtncttataactatgtctcctggtaccaacaaccaccacggccacggcccccagacctcattcatttctgatgtcagtgacgtcggtcccgtttgggactttctaatcgtcttctctgcctacagtctggcaacgccgtcttcctcgacctatccgtccgggctaccncgcgtgacggacgagctctattactcngcagcttcattcacctacccgagggtccacttcgtcgtagtactacggtcggacggtacggtccgtggctcggtacccgtccgtaccgacgtaccgacccgtacgg

SEQ ID NO: 176649 - DNA, 687 bp, Homo sapiens
  misc_feature: GYAE6OF02JP75U.10.72.G06.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
tcagcatagtagtgcacgaccggtgctcgatttagctacgactgcaagggaaagggggggtctcaggaggcagcgctctcgggacgtctccacatggcctgggctctgctattcctcaccctcctcactcaggcacagggtcctggcccagtctgccctgactcagcctgactccgtgtctggtctcctggacagtcgatcactatctctagcactggcacagcagtnacatagtgcttataactntcgtctctggtacagcaccaccaggacaaacgccccaaacttcttgtttgagtacgagtaacgccggtacctcgacgtcgtaccctagtacgtcggttctcgtcgccctacgacgtcgtcgaccaacgtccgtcctcctacgtacccgtcgtcgtcggccttaccgacggtcgttacggacggtacgtggacggtacgttacgtactttaacgacgttaccgaacgtacgtccggaacttacgttacgttaccggaacccggttaaccccgtaaagggttcgggtttacgggttaccggtccgggtaacggggttaccggtacggttaccgggtaacccggttcgggttaccgggtaccgtaaccggaacccggtaaaccggttcccgtacccggttcccccggtacggtttacccgttaccgttcccggttaacccccgg

SEQ ID NO: 176650 - DNA, 570 bp, Homo sapiens
  misc_feature: GYAE6OF02JB7AP.10.72.G06.1.454.CMB.1.raw
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (421)..(421): a, c, t, g, unknown or other
  misc_feature (421)..(421): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctagtaccaacacaccaggccacggccccagactcatcatttctgtatcgtcgagtgactccggtcctttgggactttctaagtctcttctctcgcctacagtctcggacacncgcttccnaccntccgtcggctccacgctcgaggacgagctcattactncgcagctacatacaccgacccgtagggacctacctcgttacgtacgtaacgttacggttcggggacggtaaccgggtaccggtacgggtccgttaaccggtacccggttacccgttacggacccgtacccggtcccggtaaacccgggg

SEQ ID NO: 176651 - DNA, 763 bp, Homo sapiens
  misc_feature: GYAE6OF02IO920.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctccgtggacagtcgatcactatctcctgcactggcaaccgagcagtgacagtaggtgacttaataaactatgtactcctaggtaaccaacaaccacccacggccacggacccccagactacatactatttctgtatgtcagtagacgtcggtccctttaggtactttacaacttccgtctttaccttccgtcgtacccttaccgtaaacgttccgtcgggacctaaaccgaccgggtcctttacccgtcgtaaccctagtcccgtacccgggtccctacccgtaccgccgttaggaacggaaccggttaagggttacctttaaagttttaacgttaacgtacgtaaccgtaacgtccgttaaccgaaactttaccgttaaacccgaaccccggtaagggggtcccctaaacgttcccgtaccgggtttaacggtaacgtttaaccgggtttaccgggaacccgggggttaaccgggtaccccgggttaggtaccccgttaccgggtaccccggttaacccccggttaacggtccccggtaaacgggtaccccccgtaaagggttcccccccgg

SEQ ID NO: 176652 - DNA, 886 bp, Homo sapiens
  misc_feature: GYAE6OF02JXKOJ.10.72.G06.1.454.CMB.1.raw
  modified_base (197)..(197): a, c, t, g, unknown or other
  misc_feature (197)..(197): n is a, c, g, or t
tcagcatagtagtgcacgaccggtgctcgatttagctacgactgcaagggaaagggggggtcgtcgaggaggcgagcgctctcgggacgtctccaccatggcctgggctctgctattcctcacactcctcactcagggcacaggtcctgggcccagtctgccctgactcagcctgactccgtgtcgtggtcctccgnggacacgtcgatacactatcctcctagcctacgtcggccaccgagccgtagtgactagtacggtgtacttaactaactacgtgtcctaccgttacggtaacccctaaacaaacccgaccccgacgtacccgaaccggtccccccgaagaccttcaacctcttactttaccgtagtacgtttacgactacggttcgaaccgttccccggggttttccgtttacggggtttaacttttaccgttaaacgttcccggtttaaccgttttacccttccgttacccgtaccctttaaccccgtaacggttacccggtttaccggaacctaacccggttaacccggttcccgttaccccgttacccgttaacccgttaacccgttcccggtaccccgggtacccgttaccccgaacccggtcgttaaccgggacggttaaccgggtaccggtaccgttaccgtaacgtttacgttaaccgttacgtaccgtacgtaccttaccgtaaccgtttaaccaacccgtaaccggtaaccgggacccttaccgttaccggtacccttacgggtaacgtttccgggtaacccgggttaacggggtaaccgggttaacccggtttacccggtacccggttaacccgggtccccgtttaccccgggtttaaccgttacccccgggaaccggttaacccccggg

SEQ ID NO: 176653 - DNA, 572 bp, Homo sapiens
  misc_feature: GYAE6OF02IP6A1.10.72.G06.1.454.CMB.1.raw
  modified_base (229)..(229): a, c, t, g, unknown or other
  misc_feature (229)..(229): n is a, c, g, or t
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
tcagcatagtagtgcacgaccggtgctcgatttagctacgactgcaaggggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctctggacagtcagtcaccatctcctgcactggaaccngcagtgactttgtgcttataactatgtctctggtaccagcaccaccagcaaacgccccaaactccttgttttgagtcagtaacgcgcctcaggacgtcccngatcggtctctcgcctcaagtctggcaacacgcctccncgaccgtctcgtggctccgaggctgagtatgagctgattactactgcagcgatattacgttaccgacggaccccaagtgggttagtttcgggacgggtcggtaacgtaacgggtcgacccggttccgtgggtaccaacggacccgaaggccctaccggcccccgttcggtacctacccgttccgttccgttaccccctaccccg

SEQ ID NO: 176654 - DNA, 701 bp, Homo sapiens
  misc_feature: GYAE6OF02IYOF2.10.72.G06.1.454.CMB.1.raw
tcagcatagtagtgcacgaccggtgctcgatttagctacgactgcaagggaaaggggggggtctcaggaggcagcgctctcgggacgtctccaccatggcctggctctgctattcctcaccctcctcactcaggcacagggtcctgggcccagtctgccctgactcagcctgactccgtgtctgggtctcctggacagtcgatcactatcctctgcactggacaccagcagtgacataggtgtacttataactatagtcctcgtacggtaaccaacaaccacccacgccacggccccagactcactactatttctgatcgtactagtgacgtccggttcccgtttaggtactttaccttaactccgtacctttcctcgttcgtaccctaccgtaacgttccgtacggacctaaccgtaccggttcccttacccgtacgtaccctaaccgttcccgtacccggtcctaccgaccgtacgtaggaccggtaaccggtacggtccttacgtaactttaacgttaccgtacgtaccaggtacctaactacgttaaactacccgtaacccggaacggtcccaaaccgttccgttacgtacgtacgttaccggttaccgggaccggggtaacggtaccgttacgggtaccgttaccggtaaccccggttaccgtacccggtacccgtacggtaccccgtaacccggg

SEQ ID NO: 176655 - DNA, 642 bp, Homo sapiens
  misc_feature: GYAE6OF02GI7Y2.10.72.G06.1.454.CMB.1.raw
  modified_base (330)..(330): a, c, t, g, unknown or other
  misc_feature (330)..(330): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacgagggtcctgggcccagtctgccctgactcagcctgcctccgtgtctggtctctggacagtccatccaccatctcctgcactcggacccactagttacagttggtaataatagtaattagtcgtccttacgtacggtaaccaactacgtacccaggaccaaaaccgcccccaaagtgaatacgtatttagngtatagtacaagtaactccgtaccctgtaggtttcagtactcgtctttctcgcctacgaatcgtcggacctaaccgaccgtccctaccgtacgacctacgtccgtcggtcgtaccctacgagtaccgtggaacggcgtagtacgtagtaacttaacgtacgtagccgtatcctacactaacgacgtaaggaccgcggtacgggttcgggttagggtacggttcggggaccgggtaccacgtccgtaacggtcccgttacgacggtacccgaccgaccgacgtcccgcccgtcccgtcggtcctacgttcccc

SEQ ID NO: 176656 - DNA, 734 bp, Homo sapiens
  misc_feature: GYAE6OF02GGJO2.10.72.G06.1.454.CMB.1.raw
  modified_base (182)..(182): a, c, t, g, unknown or other
  misc_feature (182)..(182): n is a, c, g, or t
  modified_base (216)..(216): a, c, t, g, unknown or other
  misc_feature (216)..(216): n is a, c, g, or t
  modified_base (230)..(231): a, c, t, g, unknown or other
  misc_feature (230)..(231): n is a, c, g, or t
  modified_base (296)..(296): a, c, t, g, unknown or other
  misc_feature (296)..(296): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtntctgggtctcgtggacagtcgatcactatctccngcacgtggccaccnncgagtgactagtggtgtacttaataactagttcgtacctaccgtacggaaccctaaaccgaaccncccgtacggcccaccggacccccgagacctcctatcctacttttcacgtagttcgtacgtaggtcgtaacgttccggttccgtttagggtacttttaccgtaacgtccgttaccttcgttctacggtccctaccgtaacgtcgtacgactaaccgcgttaccttcccgtacgtaccctactccccggtacccgggtacccttcccgccggtacgttacgggaacgggtaccggaccggtaccttaccgtaaattttccgtacgttacggtacccgtagttaccttaaccgtaaccgttaactaaccccggtaaccggtacgggtaccttacggtaccttacggtacgttagttaccggtaccggggtaccggtaccgggtaccgtacggtcccgtacggtacccgttccggtaccgaccgtaccgtacccgtacccgg

SEQ ID NO: 176657 - DNA, 705 bp, Homo sapiens
  misc_feature: GYAE6OF02IDHSG.10.72.G06.1.454.CMB.1.raw
  modified_base (141)..(141): a, c, t, g, unknown or other
  misc_feature (141)..(141): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
tcagcatagtagtgcacgaccggtgctcgatttagctacgactgcaagggaaaggggggggtctcgaggaggcagcgctctcgggacgtctccaccatggcctgggctctgctattcctcaccctcctcactcagggcacngggtcctgggcccagtctgcccctgactcagcctgactccgtgtcgtgggtctccgtaggacaggtccatcaactntcncctgcactggcacgagctagtcgacagtaggtgcttaacaactagtcgtctccgtacggtaacaaccaacgacccaggccaaccggtccccagtactctacnctatttcgngtactgtacngtcgagtccggtccgtttaggtactttcgtaatccgtctttccgacttcgacccttcgtaaatccgtacggacctaacggtaccggtccttaccccgtagaccctaacggttccgtcccggtccgtacctacgggccttagggaaccggtacggaacggtcccttactaacgttaacgtttaccttcggaaacgttccggacttactaaccgtttaaacgacccgtaacccggggttagacccgaacgtttcgtaccggttaagtccgtttaacgttacccggggacgggttaaccgaccgggttcggcccgttacggtacccggttaccctaaccggtttcgacccgggtacctaaacccggg

SEQ ID NO: 176658 - DNA, 674 bp, Homo sapiens
  misc_feature: GYAE6OF02FNLU0.10.72.G06.1.454.CMB.1.raw
  modified_base (243)..(243): a, c, t, g, unknown or other
  misc_feature (243)..(243): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcacagcagtgacagtaggtncttataactatgtctcctagtaccaacaacaccaggacaaacgaccccaaactccttgttttgaggtcagtaagccggcctcaggcgtccctgacgttcggttctctcgcctaccgaagtctcggaccaacgccgtccctccctacggtacccgtctcgtcgggtcctccgaggcttggacggtagtcggacggtctagtaacttaactacgtcgcgacgccgtactacttacgtaccgtaccgaccccgtaaggtacggggtttcgttacggggaccggggtccgggtaacgttaacggggttacgtaccccggttaccggttacggggtaccctaaccgggaccccgtaaaccgggtcccgttacccccgggtcccccggttccgggtaacccttaccccggttccgtttcccccggttacccccccgg

SEQ ID NO: 176659 - DNA, 728 bp, Homo sapiens
  misc_feature: GYAE6OF02FU81Y.10.72.G06.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
tcagcatagtagtgcacgaccggtgctcgatttagctacgactgcaagggaaagggggggtctcaggaggcagcgctctcgggacgtctccaccatggcctgggctctgctattcctcaccctcctcactcgagggcacagggtcctgggccccagtctcgccctgactcagcctgactccgtgtctggtctcgtgacngtcgatcactatctcctgcctacgtggccaccaggccaggtnacagtagtnacttatactntcgtctactagtaccaacaaccaccgagccgaccgccccagacctcacttctatttcgtgtactcgtactaggtcgaaccggttccggttccggtttaggttaccttttacgttaaccgttccgtcctttcctttcgttccgtacccttaccgttaacgtccggttaccggaaccttaaacccggtccgttacccgtttaccccgtaacgtacccgtaaccgttccccgggtaacccgggttccctaccggtacccggccggtacggaccgggtacggaccggttaccttacgttaagtttacctacggttccgccgttaacgcttacctaagttaccgaacccggtacccggtaccgtcttacccgtcgtttacgttacgtaccgttcgggtacgggtccgggtaaccgggtctaccgggcgtaaccggtcccggtaaccgtccggaacgtacccggaccgtcccgg

SEQ ID NO: 176660 - DNA, 781 bp, Homo sapiens
  misc_feature: GYAE6OF02G281B.10.72.G06.1.454.CMB.1.raw
tcagcatagtagtgcacgaccggtgctcgatttagctacgactgcaagggaaaggggggggtctcaggaggcagcgctctcgggacgtctccaccatggcctgggctctgctattcctcaccctcctcactcgagggcacagggtcctgggcccagtctgccctgactcagcctgactccgtgtcgtgggtctctggacagtcgatcactatctcctgccacgtggccaccagcgagtgactagtaggtcgtactttaagtaacttatgtcctccgtcggtaccagcctaacccaccgaggacaacccgcccctaattccgtttaggtttcggacgtcaggtacgccgcctgaggcctccgtagtactcggttcacgtcgcctaccgagtcaggaccaccggtaccgtccctacccgttacgacccgttccgtcggtccgggtacctacccgggtaggtacctaggggtaaaggcttacgggtaacgggtccttaagttaaccgttttacccgtaacgttcggaacgtacggacccgtacttaacggtttaccgtacccggtacccgggtaaacccctaagggggttaaccgggttttcgggtttacgggggacccgggttaacgggttaaaccgggttacgggttacccggtacccggggtttacccgggaccgggttaaccggggaaccgtaacccccggggttaacggtccccggttaaccccggggtcccccgtttacccgggtaaccctttcccggttaccccgtttccccccggg

SEQ ID NO: 176661 - DNA, 699 bp, Homo sapiens
  misc_feature: GYAE6OF02I7GIZ.10.72.G06.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcgagggcacagggtcctggcccagtctgccctgactcagcctgactccgtgtcgtgggtctccgtggacagtcgatcgactatccgtctgccacgtggccaccngcagtanactagtaggtgtacttataactatgtactccgtaggtaccaacaaccacccaggcccaccggtaccccccaaggaccctacgtacctactacgttttccgtagtacttgtcgtaggtcggtacgtccgggttcccgttttaggggtaacttttaccgtaacgtttccgtaccgtttcctcgttcgtccctaccgtaacgtcgtcggacctaaccgtaccggttccctcccgtacgtaccctacgttacccgtaccggtcctaccgaccggacgtcggtacggaccggtacgtcctacttagttacgtacgtcgacacgttccgactacgttaactacccgaccgttaaccgggcctaacgtaccttaggtacgtacgttaccggtccgggacgggtaccggtcgtacggtccgttaccgtaccggtccgttaaccgccgtaccggtacccggtaccg

SEQ ID NO: 176662 - DNA, 749 bp, Homo sapiens
  misc_feature: GYAE6OF02HXQ70.10.72.G06.1.454.CMB.1.raw
tcagcatagtagtgcacgaccggtgctcgatttagctacgactgcaagggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctctgacagtcgatcactatctcctagcactggcaccgagcagtgactagtaggtcgtacttaataactaattcgtaccttccgtacggtaaccaaacgaaccacccgacggacccaccggcccccagtacctcactactactttcagtactgtactagtcgaacgttccggtccgtttagggttaactttactaacgtccgtaccgtttctcttcgtccctacgtaacgttctacggtaccgaaaccgtccggtcccttacccgtcgaacccttaccgttacccgggtccccgggtacctacccgtaaccgtcgtacgggaacggtaccggtacggtaccttacgttaactttacgttacgtcggaacttaacgaccttaacctaattaaccgaacccgacccggtaaggggtaccctaaccgttcgttaccggtagttacggttacggtaccggggtacggggtaaccggtacccggttcggtaacccggtttccggtaccccggtttaacccggttaacccggtaccggtaaccccgggtacccggtaacccgggg

SEQ ID NO: 176663 - DNA, 712 bp, Homo sapiens
  misc_feature: GYAE6OF02F491F.10.72.G06.1.454.CMB.1.raw
  modified_base (229)..(229): a, c, t, g, unknown or other
  misc_feature (229)..(229): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccgngcagtgacttttgtcgtacttaataacttatcgtctccgtcggtaccacgccacccacccaggaccaaaccgaccccctaaacttcctttagttttagacggtcgtaaggtaacggccggtccctacgacgggtacctcccgtagtacgtttccggttacttccgtcggtacccttaccgtaaacgttctaacggaccaaccgtacccggtaccccttcccgtacggtacccgttccgttccggtaccgggtcctacccggagggtaccgtgggaacggtacgttaggacgggtcgtacgttaacgttacctacgtcgtacgacgtctactagttaccttacgaccggaccccgtaaggttggggttacggttcggcgggtacggtacggttaacggtccgtaccggtcggtcgggtaccacggtacccgtacggtccgttccggaccccggttccgcctaccgttccgtcccgttcccccgg

SEQ ID NO: 176664 - DNA, 740 bp, Homo sapiens
  misc_feature: GYAE6OF02GQDXS.10.72.G06.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcacgcctgactccgtgtcgtgggtctcctggacagtcgatcactnctccngcactgcacagcagtcgacagtaggtcgcttataactagtcgtctccgtaggtaccagccaccaccgaggaccaaaccgaccccctaaacttcctttaggttttaggacggtcgaagttaacgccggtccctagtacggacgtcctgtacgttccgttcctccgtcgtcccttaccgtaagttccgtacggaccaaaccgtaccggtacccttcccgtacgtacccgttccgtcggtaccgggtcccttcccgaggtccgtaggacgtagtacgggtaggtacgtacggttacttacgttacgtagacccgagaccggtacctaagttaccgttaccggaacccggtaacccgtaacgggttaggggttcgggttacggggccgggtaccgggttaaccggtacgggttacccggtacccgggttcccggtacggggttacccgaaccggtaccccggtaacgggtccggttaccccggtccccgttaccgggtacccttaccccggtcccgtttaccccccg

SEQ ID NO: 176665 - DNA, 649 bp, Homo sapiens
  misc_feature: GYAE6OF02JP8VH.10.72.G06.1.454.CMB.1.raw
  modified_base (215)..(215): a, c, t, g, unknown or other
  misc_feature (215)..(215): n is a, c, g, or t
  modified_base (585)..(585): a, c, t, g, unknown or other
  misc_feature (585)..(585): n is a, c, g, or t
tcagcatagtagtgcacgaccggtgctcgatttagctacgactgcaagggaaagggggggtctcgaggaggcagcgctctcgggacgtctccaccatggcctgggctctgctattcctcaccctcctcactcagggcacacgggtcctgggcccagtcctgccctgactcagcctgactccgtgtcgtgggtctccgtaggacagtcgatcactntcctctgcactggcacagcagtcgacagtaggtctacgttactaactatgtcctacgtccggtaaccaacaaccacccgacggacccaccggaccccgagacctactactcttattacgtagtactgtacagtcgacgttccggtcctttggtactttacgtacgtcgtccttactctcgacctacctaagtcctcggaacctaccgtaccggtccttccctacgtaaccctcgtacccgtcccgggcctccgaccgcgtaggacggtacgcggtacctcgtagttacttaccgtcacgacgttcctactacgtaactacccgacccggacggtcctccgtcttaggtacgtaacgttcggttaccgggnggtaaccggggtccgtcggtaccgtacccggttccgtacccgttacgccgtaccgacgtaccgg

SEQ ID NO: 176666 - DNA, 707 bp, Homo sapiens
  misc_feature: GYAE6OF02G0E06.10.72.G06.1.454.CMB.1.raw
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (543)..(543): a, c, t, g, unknown or other
  misc_feature (543)..(543): n is a, c, g, or t
  modified_base (564)..(564): a, c, t, g, unknown or other
  misc_feature (564)..(564): n is a, c, g, or t
tcagcatagtagtgcacgaccggtgctcgatttagctacgactgcaagggaaagggggggtcgtcgaggaggcagcgctcgtcgggacgtctccaccagtcggcctgggcctcgtgctactttcctccgacccctcctcgtacctcgagggccaccgcgggtccgtgggccccagttcctcggcccttacgaccgtacncggtccctacgccgttccggtctcggttcgggtccttccggaggaccgtagccgtatacaccttnttccgtccgtgccctaggtaccggtccaaccgaggcgtaggacacctaggtccggttntacgttataactatcgtctcgtacgtacaacacaccacncgaccgcccacgacacactactcttactcgtagtctctgtacgtcggtccgtcggtttcgttacttacgttacgtcgttacttccgtctaccgctacgtacgttcgacgtcgaactccgtcctcctactactcgtacccgtccgtcctaccgcgtaccgtggaccggacgtacgtaccgttntacgtacttacgtcgacgtcnccgtagtactaccgtacggaaccgtcgggacttccggttacttacggtcgtaacgttcggtaaccgggacgggtaccggttaccggacggtaccgttaccggacccggtttacgacccgttacgtacccgtaccggtaaccgg

SEQ ID NO: 176667 - DNA, 649 bp, Homo sapiens
  misc_feature: GYAE6OF02FUEOA.10.72.G06.1.454.CMB.1.raw
  modified_base (329)..(329): a, c, t, g, unknown or other
  misc_feature (329)..(329): n is a, c, g, or t
  modified_base (481)..(481): a, c, t, g, unknown or other
  misc_feature (481)..(481): n is a, c, g, or t
  modified_base (520)..(520): a, c, t, g, unknown or other
  misc_feature (520)..(520): n is a, c, g, or t
  modified_base (541)..(541): a, c, t, g, unknown or other
  misc_feature (541)..(541): n is a, c, g, or t
tcagcatagtagtgcacgaccggtgctcgatttagctacgactgcaagggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctcctggcagtcgatcactatctcctgcactggcaccgagcagtgacagtaggtcgtacttataactatgtctccgtacggtaccaacaaccaacccaggccacggcccccaagactcatctatttctagatgtcagtntacgtccggtccgttgggtactttcgtaatcgtccttctcttcgaccctcaacgtctcgacaacctcggtccttccgtagacctctacccgtcgggtcctacgaccgcgtaggacgggtaacgtcggtactcgttaaacttacgtttaccgngtaccgtacgtcttacgtagtaacttacccgaacccggngggacctacgtcgtaccggtnttaacgttacggttaccgggccggggtaaccgggtaccggtacggttacgtaccggttacccggttaacccgtaccggtacccggtacccggacccggttaacccggg

SEQ ID NO: 176668 - DNA, 626 bp, Homo sapiens
  misc_feature: GYAE6OF02G52NW.10.72.G06.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgacctccgtgtctgggtctccgtggacngtcgatcactatctcctgcacgtggcaccancagtnacagtaggtcgtacttataactatgtctacctggtaccaactaaccaccacggccaccggaccccacgactctactcatttcctgntntcagtgactcggtccttggtactttataactcgtcttctctcgcctactacgtcgtacgaccacgtacggtcttccctacgacctacgtccgtcccgggacctccgaccgcgttaggacggaccgtacggcttactattactacgtgactacgtccttagtacttactaacccgaccgggtaacgggacctacgttaccgtagttacgtaagttacggtcccgggtaacgggacgggtaacggtcggtcgtaacccgggtaccgttccggttaccctaccgtaccggtacccgtaaccggg

SEQ ID NO: 176669 - DNA, 750 bp, Homo sapiens
  misc_feature: GYAE6OF02I4N1I.10.72.G06.1.454.CMB.1.raw
  modified_base (356)..(356): a, c, t, g, unknown or other
  misc_feature (356)..(356): n is a, c, g, or t
  modified_base (596)..(596): a, c, t, g, unknown or other
  misc_feature (596)..(596): n is a, c, g, or t
  modified_base (716)..(716): a, c, t, g, unknown or other
  misc_feature (716)..(716): n is a, c, g, or t
  modified_base (731)..(731): a, c, t, g, unknown or other
  misc_feature (731)..(731): n is a, c, g, or t
tcagcatagtagtgcacgaccggtgctcgatttagctacgactgcaagggaaaggggggggtctcaggaggcagcgctctcgggacgtctccaccatggcctgggctctgctattcctctaccctcctcactcgacgggcacgacggtcctagggcccagtctgccctgactcagcctagactccgtgtcgttcgggtcctcgtaggacagtcgactctactatcctctgactacgtgaccacacgctagtacaacgtagtaggtcgtacttaactaactattacgttctaccgtacgtaacccaaaccaacctacccgacggcctaccgacccctaacgactacgtactaccgtntttacagtacttagtacgtaggtacgtacgttcccggttccggtttaggttacttttaacgtaacgtcccgttcgttacctttcgtacgtacccttacgtaccggttaccgtccggtaaactaacccggtccgttaccgttacccttaaccgggtacccctacttaccccgggttcccgtcccgtaccgtccggtaacgttaccgacggtacgacggtactaacttacgtttaccgttanccgtagtccgtactacgtaacgttacaaccgtaccggcgtacgtaaccttcgtccttagacgttccggttacgggtacggtaaccggtcgttacggaccgtttaccggacccgttaaccncccggggtttaaacncccgtaccggtaaccccgg

SEQ ID NO: 176670 - DNA, 717 bp, Homo sapiens
  misc_feature: GYAE6OF02GYZQF.10.72.G06.1.454.CMB.1.raw
  modified_base (267)..(267): a, c, t, g, unknown or other
  misc_feature (267)..(267): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcgtggacagtcgatcactatcctcctgcacgtcggaccaccgagcagtcgaacagttaggtgtactttaataactnttcgtccttaccgtacggtaaacccaaccaaacccgtaccccgaccggaccccgaacccggtaccccccgaagtacctaccgtaacttccttacgtttcctagtacttcgtacgtaggttcgtacgttccggttaccgttttaggttactttacgtactccgtcctttactcgtaccgtccctaccgtaacgttccgtacgacccgtaaccgtaccgttcccttaccctacgtaccctagttccccggtcccggtaccctccgaccgtcggtaacggaccggacgtaccggtcttaacgttactttaacgtccgtcgaccgtacgtcttaccgtaacttaccggtacccgaccgggtacggtactaccgtcgttacggtcgttacgtcgggtacggacggtacggtcgtacgtcgtaccgtcctacccgtagccgtaccgaccgtaccgg

SEQ ID NO: 176671 - DNA, 705 bp, Homo sapiens
  misc_feature: GYAE6OF02HHL14.10.72.G06.1.454.CMB.1.raw
  modified_base (393)..(393): a, c, t, g, unknown or other
  misc_feature (393)..(393): n is a, c, g, or t
  modified_base (559)..(559): a, c, t, g, unknown or other
  misc_feature (559)..(559): n is a, c, g, or t
  modified_base (597)..(597): a, c, t, g, unknown or other
  misc_feature (597)..(597): n is a, c, g, or t
tcagcatagtagtgcacgaccggtgctcgatttagctacgactgcaaggggaaaggggggggtctcaggaggcagcgctctcgggacgtctccaccatggcctgggctctgctattcctcaccctcctcactcagggcacgacgggtcctgggcccagtctcgtccctgactcacgctgaccgtccgtgtcgtggtcctcgtggacagtcgatcatactcctcctgccacgtcggaccaccgagccgtagtcgaagagttacggtctactttaaactacgtagtacgttacctccgtaacggtaacccaaacgtaaccgtacccgaaccggacccgtacccggacccccaagtaaccctacgaccttacgtactttcgacgtcgtggttaacngttacgtacgttccggtttacgttggttacctttataaccgtcgttccttccgtcgtcgtacctacgtaacgtcgtacgaactaccgcgttcctccgtacgtcctccgttcccgccggtctaccgcgtacgacgggtaccgtagccgttactactacgttatacgngtctaagtcctaacgtacgtacctaacggacccgggtntaacccgtccttcgtaaccgtattcgggtacggttcgggaaccgggttacggccgttacgtcccgtcggttacccgttacgacccggttacggaccctacggtaccgg

SEQ ID NO: 176672 - DNA, 733 bp, Homo sapiens
  misc_feature: GYAE6OF02HYBUM.10.72.G06.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (578)..(578): a, c, t, g, unknown or other
  misc_feature (578)..(578): n is a, c, g, or t
tcagcatagtagtgcacgaccggtgctcgatttagctacgactgcaaggggaaaggggggggtctcaggaggcagcgctctcgggacgtctccaccatggcctgggctctgctattcctcaccctcctcactcgagggcacgagggtccgtgggcccagtctcgccctgactcagcctgactccgtgtcgtgggtcctaccgnggacagtcgatcactatcctactgcacgtcggccaaccgngactaggtcacgtagtaggtgtacttaacgtaacttntacgtccttctacggtaaccaacaaccacccgacggcccacccgccccagtacctctaactctatttccgtagtacgtctactaggtgtaccggttccgggttccgtttagggttacctttacgtaccgtttccgtacctttcgtccgtccgtacccgttacctaacgttcgtacgtacccgtacgtcccgttacctacccgtcgtacctccgttcccggtcccgtaaccctccggtacgaccggttcggaacgggtaccgtaacggttccgtactttaaacgttctcggaccgtacnccgtaactacgtaacgtaaccacccggtaaccggcggtaccaccgtttacgtaccgtagttacggttcggggtcggtaccggggaacgtccggtacggtaaccgtccggttaacccggtaccgttacccgaacggtacccgtacccggtacccgg

SEQ ID NO: 176673 - DNA, 602 bp, Homo sapiens
  misc_feature: GYAE6OF02FRLWL.10.72.G06.1.454.CMB.1.raw
  modified_base (181)..(181): a, c, t, g, unknown or other
  misc_feature (181)..(181): n is a, c, g, or t
  modified_base (534)..(534): a, c, t, g, unknown or other
  misc_feature (534)..(534): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactcgtntctgggtctcctggacagtcgatcactatctcctgcactggccaccagctagtcgaactagttacggtgtacttaagtaaactattcggttcctcccgttacggtaacctaaaccaaacctacccgaacggcccacgggccccccaagaccttcatcctactttctgtattcgtagtagtgtactccggtccgtttggtatttctagtcgtcttctctcgcctctaagtctcgacacgcgtccttcctagacctgtccgtcggcctccacgtctcggacggtacgcggtactctaacgttactacgtcgtactcgctactactacgtaccgaccgcggactacgtcgtcgtanacgttacggtcggacgggtacggtaccgtgccgttacgtaccgttccgtacctcgacgtaccgtacgg

SEQ ID NO: 176674 - DNA, 794 bp, Homo sapiens
  misc_feature: GYAE6OF02H7R2J.10.72.G06.1.454.CMB.1.raw
  modified_base (196)..(196): a, c, t, g, unknown or other
  misc_feature (196)..(196): n is a, c, g, or t
tcagcatagtagtgcacgaccggtgctcgatttagctacgactgcaagggaaaggggggggtctcaggaggcagcgctctcgggacgtctccaccatggcctgggctctgctattcctcaccctctcactcaggcacagggtcctgggcccagtctgccctgactcagcctgactccgtgtctgggtctctggacngtcgatcactactctctgcactggcacagctagtgactagtaggtgtcgttaataacttactgttccttcctacggttaacccaaactaaaccaacccacgggaccctaaccgggtaccccccgaaggtaccttacctaacgtccgtaaacgttttctacggtattacggttaccgtagttacggtacgttccgggtaccccgttttacggggtacttttaccgtaaacgtttccgtacctttcgtaccgttacggtacccttaccgtaaaacggttaccgtacgggtacccgtaaaaccggtcccgggttaacccttttccccgaacgttaaccccgtaacgttaccccggttacccgggtacccttacccgaccggtaccgtacgggtaccgggtaacggacggtacctaccgtaatttacgtacgtacgcgacgtaccgtacgtactaacgtaccaacccgggtacgggtaccacgtttaccgtacgtacgtaacgttaccggttaaccgggtaccggtaaccggggtacctcgggtaaccgtccggttaacccggttccgttaaccggtcccgtaaccggaccccggtaaccgg

SEQ ID NO: 176675 - DNA, 783 bp, Homo sapiens
  misc_feature: GYAE6OF02IJZXH.10.72.G06.1.454.CMB.1.raw
  modified_base (233)..(233): a, c, t, g, unknown or other
  misc_feature (233)..(233): n is a, c, g, or t
  modified_base (535)..(535): a, c, t, g, unknown or other
  misc_feature (535)..(535): n is a, c, g, or t
tcagcatagtagtgcacgaccggtgctcgatttagctacgactgcaaggggaaaggggggggtctcaggaggcagcgctctcgggacgtctccaccatggcctgggcctctgctacttcctccacccgtcctcactcgagggcacgaggtcctgggacccagtctcggccctgactcagcctagacctcggtagtcgtgggtctccgtaggactagtcgatcgactatctccngctacgtggtacacgtagcgagtcggaactagtaggtcgtacttaactaacgttgtcgtccgttacgtacgtaaccaaccgtaaccgaacccgtacggtacccgaccggaccccgtaacggtacctacgtactaccgtactttaccgacgtacttcgtacgtacggttacgaccggttccggttaccgtttacggtaacttacgttaccgcgtttaccgttactcgttccgaccttacgtacgttcgtacgtacctacggtacccgtccttacctcgtaacctcgtacccggtcccggtacnccgttacgccgtaagggtaccgacgtcgtactacgtacttacgtacgtcgtacgtaccgtctaaccgtagtaaaccctccggacccggttaaggtacccttacgggtttaccgtaccggtttacgtaacgggttccggtaaccgggtacgggtacccgggttaacgtcccgggttaacccggtccggttaaacccggtccggtttaaaccccggtacccgggtaacccggttaccggtaaaccccggg

SEQ ID NO: 176676 - DNA, 326 bp, Homo sapiens
  misc_feature: GYAE6OF01EZPLY.1.77.G11.1.454.CMB.1.raw
  modified_base (295)..(326): a, c, t, g, unknown or other
  misc_feature (295)..(326): n is a, c, g, or t
tcagacgagtgcgtcacgaccggtgctcgatttagctagtcactctcgcgggcatccggggtccctgaccgattcagtggcagcgggtctgggacagatttcactctcaccatcagcagcctgcaggctgaagatgtggcagtttattactgtcagcagtatgggagctccaggtacacttttggccaggggaccaagctggagatcaaacgaactgtggctgcaccatctgtcttcatcttcccgccatctgaacgcactcgtctgagccgggcgtcggcgaggcgacgatagnnnnnnnnnnnnnnnnnnnnnnnnnnnnnnnn

SEQ ID NO: 176677 - DNA, 298 bp, Homo sapiens
  misc_feature: GYAE6OF02FZ5ZC.1.77.G11.1.454.CMB.1.raw
  modified_base (293)..(298): a, c, t, g, unknown or other
  misc_feature (293)..(298): n is a, c, g, or t
tcagacgagtgcgtcacgaccggtgctcgatttagctagtcactctcgcgggcatccggggtccctgaccgattcagtggcagcgggtctgggacagatttcactctcaccatcagcagcctgcaggctgaagatgtggcagtttattactgtcagcattattatagtattctttcgaccaccttcggccaagggacacgactggagattaaacgaactgtggctgcaccatctgtcttcatcttcccgccatctgaacgcactcgtctgagcgggctggcaaggcgcatagnnnnnn

SEQ ID NO: 176678 - DNA, 190 bp, Homo sapiens
  misc_feature: GYAE6OF02H5IN5.1.77.G11.1.454.CMB.1.raw
  modified_base (190)..(190): a, c, t, g, unknown or other
  misc_feature (190)..(190): n is a, c, g, or t
tcagacgagtgcgtcacgaccggtgctcgatttagctagtcactcaagggaaagggtgagatccctcactgtggctcgctttcggcggagggaccaaggtggagatcaaacgaactgtggctgcaccatctgtcttcatcttcccgccatctgaacgcactcgtctgagcgggctggcaaggcgcatagn

SEQ ID NO: 176679 - DNA, 309 bp, Homo sapiens
  misc_feature: GYAE6OF02JZ2DO.1.77.G11.1.454.CMB.1.raw
  modified_base (207)..(207): a, c, t, g, unknown or other
  misc_feature (207)..(207): n is a, c, g, or t
  modified_base (291)..(309): a, c, t, g, unknown or other
  misc_feature (291)..(309): n is a, c, g, or t
tcagacgagtgcgtcacgaccggtgctcgatttagctagtcactctcgcgggcatccggggtccctgaccgattcagtggcagcgggtctgggacagatttcactctcaccatcagcagcctgcaggctgaagatgtggcagtttattactgtcagcattattatagtattctttcgaccaccttcggccaagggacacgactgganattaacgactgtgctgcaccatctgtctcatcttccgcatctgaacgcactcgtctgagcgggctggacaaggccgacatagcnnnnnnnnnnnnnnnnnnn

SEQ ID NO: 176680 - DNA, 302 bp, Homo sapiens
  misc_feature: GYAE6OF02FQVUO.1.77.G11.1.454.CMB.1.raw
  modified_base (293)..(302): a, c, t, g, unknown or other
  misc_feature (293)..(302): n is a, c, g, or t
tcagacgagtgcgtcacgaccggtgctcgatttagctagtcactctcgcgggcatccggggtccctgaccgattcagtggcagcgggtctgggacagatttcactctcaccatcagcagcctgcaggctgaagatgtggcagtttattactgtcagcattattatagtattctttcgaccaccttcggccaaagggcacgactggagattaaacgaactgtggctgcaccatctgtcttcatcttcccgccatctgaacgcactcgtctgagcgggctggcaaggcgcatagnnnnnnnnnn

SEQ ID NO: 176681 - DNA, 506 bp, Homo sapiens
  misc_feature: GYAE6OF01CSPJ9.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagccctaagctcttgatctatggtgcatccagtttaaaagtgggtacccatcaaggttcagcggcagtggatctggcacagacttcattctcaccatcagcagcctgcagcctgaagtatttgctaacttattactgtactacaagatcaactaattatccgttgggacgttcgggaccaaaggggcccaaagggtaggaaactacgaaacgaacgttggtggctacgg

SEQ ID NO: 176682 - DNA, 521 bp, Homo sapiens
  misc_feature: GYAE6OF01ADXQ9.13.48.E04.1.454.CMB.1.raw
  modified_base (369)..(369): a, c, t, g, unknown or other
  misc_feature (369)..(369): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtgggtcccatcaaggttcagcggcagtggatcgtggcacagacttcattcncaccatcagcagcctgcagcctgaagtatttgactaacttattactgtctaacaagtatcaactaattatccgtagggtaccgtttccgggaccctaaaggggacccaaagggtacggaaaactccgaaaacgtaacgtggttggcgtacgg

SEQ ID NO: 176683 - DNA, 498 bp, Homo sapiens
  misc_feature: GYAE6OF01CZUK1.13.48.E04.1.454.CMB.1.raw
  modified_base (227)..(227): a, c, t, g, unknown or other
  misc_feature (227)..(227): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaaccatcacttgccgggnaagtcaggcattaacaactattaaattgtatcagcagaaaccaggtaaagcccctaagctcctgatctacgatgcatccaatttggaaacagggtcccatcaaggttcagtgaagtggatctgggacagtatttacttcaccatcagcagcctgcagcctagaagatattgacaactatattaactgtacagcagtatgataatctaccgatctaccgttcggaccaagggacaacgactaggaataacgttaaacgacgttgtggctacg

SEQ ID NO: 176684 - DNA, 513 bp, Homo sapiens
  misc_feature: GYAE6OF01DTP9C.13.48.E04.1.454.CMB.1.raw
  modified_base (226)..(226): a, c, t, g, unknown or other
  misc_feature (226)..(226): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaaatgatttaggctggtatcagcagaaaccagggaaagccctaagctctgatctatggtgcatccaagtttaaaagtgggtaccatcaaggttcagcggcagtggatctggcacagacttcattctcaccatcagcagcctgcagcctgaagtattttgactaactttattactgtactacaagtactcaactaattactccgtagggtaccgttacggaccgtaagggacccaaagggtaggaaaactacaaaacggataggtggcgtacg

SEQ ID NO: 176685 - DNA, 492 bp, Homo sapiens
  misc_feature: GYAE6OF01B9IAJ.13.48.E04.1.454.CMB.1.raw
  modified_base (263)..(263): a, c, t, g, unknown or other
  misc_feature (263)..(263): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagnagaaaccaggtaaacgcccctaagctcctgatctacgatgcatccaattggaaacagggtccatcaagttcagtgaagtgatcgtggacagtatttacttcactatcagcagcctgcagcctagaatatattgactaacatattactgtacagcagtatagataactcctacccgatcctaccttggacccaagggaccacgactcggaagaattaaacgattgtacgg

SEQ ID NO: 176686 - DNA, 556 bp, Homo sapiens
  misc_feature: GYAE6OF01AWGLG.13.48.E04.1.454.CMB.1.raw
  modified_base (226)..(226): a, c, t, g, unknown or other
  misc_feature (226)..(226): n is a, c, g, or t
  modified_base (375)..(375): a, c, t, g, unknown or other
  misc_feature (375)..(375): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagaacattggcaactctttaaattggtatcagcagaagtcagggcaacgccccgaacctcctgactctacggtacatccactttgcacagtggatcccatcaaggttcagtggcagtagatcgtaggaactagtactttacccncacctatcagggtctacgagcctagaagtattttgcgtacttactattgtacaactagtacgtttacccttccgttacccccggtacgttccggaccgtaacgggaccgtaaacggtacggaaacgtcgaaacggacgtaacgtacggtacggtacctcggacaccgactcgtgttacccg

SEQ ID NO: 176687 - DNA, 724 bp, Homo sapiens
  misc_feature: GYAE6OF01C6C6I.13.48.E04.1.454.CMB.1.raw
  modified_base (277)..(277): a, c, t, g, unknown or other
  misc_feature (277)..(277): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtcaccatcacttgccaggcgagtcaggacataacaactatttaatggtatcagcagaaacaggtaaacnccctaagctcctgatctacgatgactactacctaatttagggaaaacctacggggtaccccaagtaccgaaagggtttcaaaggttagggaaaggttacgggattaccgtagggggtaaacctaaggttaacttttttttaacctttaccctaacctaagttaccaaggtaccaacggtccccttaggacccgtaacgtacccgttaaggaaaaccggttaattaagtttacggaaccctaaacgtaacttttaattttaacctacgggttacaacggtactaaaggttaacttaggtaacttaaacgttccccgttaacccccggtattacccgtaaccccggttttaccgggaacccggtaaaacggggtaaccctaaccgggtaaaccgttaggggaaaacttaaacgtttaaaacccgggaaacttggggttaacggtaaccg

SEQ ID NO: 176688 - DNA, 520 bp, Homo sapiens
  misc_feature: GYAE6OF01B2A4Z.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaatgatttaggctggtatcagcagaaaccagggaaagccctaagctcttgatctatggtgcatccagtttaaaagtgggtaccatcaaggttcagcgcagtgatctggcacagacttcattctcaccatcagcagcctgcagtcctagaagtattttagctaactttattactgtactaacaagtactcaactaatttatccgttagggtacgttcggaccgaacggggtaacctaaagggtaggaaaacgtacaaaacggaactcggtaggtcgtacg

SEQ ID NO: 176689 - DNA, 507 bp, Homo sapiens
  misc_feature: GYAE6OF01BAT99.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccaggtaaagccctaagctcctgatctacgatgcatccaatttggaaacagggtccatcaaggttcagtggaagtggatcgtgggacaggtattttacttcaccatcagcagctgcagcctgaagtatattgacaactatattactgtcagtcagtatagaataatctacccgatccgtaccttcggaccctaaaggggaccaacggactaggaagtaattaaaccgaagtggtacgg

SEQ ID NO: 176690 - DNA, 503 bp, Homo sapiens
  misc_feature: GYAE6OF01BEJ1U.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccaagtttaaaaagtgggtcccatcaaggttcagcggcagtggatctggcacagacttcattctcacatcagcagcctgcagcctgaagattttgctaactttattactgtctaacaagatacaacaattatcctagggacgtttcggaccaaagggacccaaagggtagaaaactcaaaacgaactggtggctacg

SEQ ID NO: 176691 - DNA, 513 bp, Homo sapiens
  misc_feature: GYAE6OF01B4D1Z.13.48.E04.1.454.CMB.1.raw
  modified_base (399)..(399): a, c, t, g, unknown or other
  misc_feature (399)..(399): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaacgcccctaagctcttgatctatggtgcatccaagtttaaaagtgggtacccatcaaggttcagcggcagtggatctggcacagacttcattctcaccatcagcagcctgcagcctgaagtnttttgctaactttattactgttactaacaagtactacaactaattactccgtagggtaccgttcggaccgaaggggaccaagggtaggaaactacgaaacgaatggtgcgtacg

SEQ ID NO: 176692 - DNA, 659 bp, Homo sapiens
  misc_feature: GYAE6OF01C1TOF.13.48.E04.1.454.CMB.1.raw
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtcaccatcacttgccgggnaagtcaggcattaagaaatgatttaggctggtatcagacaagaaaccgagggaaacgcccctaagctcttgatctatggtncatacctaaggtttaaaagtcgggtacccatacgaaggttcaggcggctaggtggatcgtggacacgtagtacctttcactttcctacaaccatcaacgccacgtccctggaccacgtccttaggtaaacgttaatttttacggaacctttaaacgttttaactttaaccgttacggttaaccttaaactaaaggttaacttacctaaaccttaaacgtttaacgtaccccggttagggggtaacccggtttacccggggaacccggtaaaacggggtaacccgtaaaaggggttaacggaaaaacgttaacccgaaaaacggtaacgttacgggtacggtccgtaaccgg

SEQ ID NO: 176693 - DNA, 582 bp, Homo sapiens
  misc_feature: GYAE6OF01EB8RQ.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtccaccatcacgttggccgggacaagtcgagggcattaagaaatgtatttaggctggtatcagacaagaaaccgaagggaaacgaccccgtaagctcctagatactacgatgcatacctaagttacggaaacgtacggggtaccagtacgtaaggttacgaggtaggaagtaggaccccctgtaggactagttattttacttacacctatacagcacgctgacacgtccgtagaagtatattacgactaactaattaacttactagtactagtacgtagtatagtaacttaactcctacccgtactaccgtaccgttaccggaccgaacgggaccgacgtacgtaggaacgtaagttaaacgtacgtggtacgg

SEQ ID NO: 176694 - DNA, 659 bp, Homo sapiens
  misc_feature: GYAE6OF01EE466.13.48.E04.1.454.CMB.1.raw
tcagtcacgtactacacgaccggtgctcgatttagagagcgtcacagagagaagggggcaggagtcagacccactcaggacacagcatggacatgagggtccctgctcagctcctggggctcctgctgctctggctctcaggtgccagatgtgacatccagatgacccagtctccatcctccctgtctgcatctgtaggagacagagtccaccatctacttcgccgaggcgagtcgaggactaattaactaacttaattttaaagttggtactcagtacaacgaaaccgaaggtaaaccgaccccgtaagtccttacctagtacttactacgtatcgactacttacctaagtttacggaaacgtacggggtacccagtacgtaaggttcgaaggtaggtaagtggtatcggtagggaactagtttaacttttacctttaccacctattcgacgtacacgtcctagcctacgtacccgtagaagtacttacgttacgacctaaacttattaacttacgtcgtacaaggtctaagttactagtaacttacgttcccgtaacccgtagtaccccgtacccggtttacccgggaccggtaaacgggaaccctaaccgggtaacgttaagggaaaggttaaaaccttaaaaccggcgttacggg

SEQ ID NO: 176695 - DNA, 574 bp, Homo sapiens
  misc_feature: GYAE6OF01AKLD3.13.48.E04.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtagganacagagtcaccatcacttgccggnaagtcagggcattagaatgatttaggctggtatcagcaacgaaaccgagggaaacnccctaagctctgatctatggtnactataccgtaaggtttaaaaggtcgggtaccctagtacgtaacggttacacggcggactaggtggtatcgtggacacgacgtacttcacttccacacctatcagcacgcctgcacgctagatntttgactaattacttactgtactaanaagtactacaactaagttactccggtacgggtaccggttacccgggaccgtaaacggggtaccctaaaggggtaacgaaaacgtaacccgaaaacggtaacgtcggtacggtactaaccgg

SEQ ID NO: 176696 - DNA, 594 bp, Homo sapiens
  misc_feature: GYAE6OF01COQ0C.13.48.E04.1.454.CMB.1.raw
  modified_base (436)..(436): a, c, t, g, unknown or other
  misc_feature (436)..(436): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcagggcattagaaatgatttaggctggtatcagacaagaaaccgagggaaaagcccctaagctcttgaatctatggtgcataccaagtttaaaaggtcgggtacccatcgaaacggttcaggcggcaggtggaactcgtgggacacagtaccttcgtactttcctaccaacctattcgaagcacgcctgaccagtcctagtaacttnttttacgacttaaactttagttaccgtgtaccaataacgttacttaacttaccggttaccctctacggttacgtttaccggggcgggtaacgggtaacccggtaaggggtacggtaacgacgttaaaccgaaacggtacttaggttcggcgttaccgg

SEQ ID NO: 176697 - DNA, 702 bp, Homo sapiens
  misc_feature: GYAE6OF01EMROW.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtcctccatcctccctgtctgcatctgtaggagacagacgtccaccatctacttggccgggacaaggtcgagggctaagttaagaaatgtatttaggctggtatcagacaagaaaccgagggaaccgtaccctaagcttacgtagatcgtagtggtgtactaacttaccgtaaaggtttaaaacggtcgggtaccctagtacgtaacggttcaggtcggactagggttcggattccggtaggaccgtaacgtagttacctttactactttaccgtaccaaccctataccgacgcctaaccgtcccgtcgaccgtaccgtaccgttaacgggtaagtttacgttttacgaacttaaccttttaagttaccgttcgttaactaaacgtaactaacttaccgaacttaaactttaccggtaccggttacggggtaaccggttacccgggtaaaccggtaaacggggtaacccaaaggggttaacggtaaaacgtaaacccggtaaaacgtacggttcggtacggtccgtaaccgg

SEQ ID NO: 176698 - DNA, 736 bp, Homo sapiens
  misc_feature: GYAE6OF01DQVTS.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtctccactccctccctgtctgcatctgtaggagacagagtcaccatcacgttggcccgggacaagtcgagggactattaagaaatgtaagtttaggcgttaggtatcgaacgacgaacggaaaaccgaagggaaaccgaccccgtaagtccttacgttagtacttacgttaagttcggtcgtacctaacgttaacccgttaaaagggttttaaaaacgggtccggggttaacccctaagttaccggtaaacgggtttcgaacggtcgggtacgtacgggttacggtacttacggtacgggtaacctaacggtaacggttacctttacgtaaccgttttacccaccgtaaccgtacttaccgaacggtaccgaaccgtcccgttacggacctaacggtacccgttaaggtaacgttttaacgtttacgtaacctttaacgtttaacttaccgtacgttaactaacgtaagtactacaaacttacttacgtccgtagggtaccgttcggaaccggtaaggtaccgaagggttaacgaaacgtaacgaacgtagtgtacggcgtaacg

SEQ ID NO: 176699 - DNA, 600 bp, Homo sapiens
  misc_feature: GYAE6OF01DJTES.13.48.E04.1.454.CMB.1.raw
  modified_base (307)..(307): a, c, t, g, unknown or other
  misc_feature (307)..(307): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccactccctccctgtctgcatctgtaggagacagacgtcaccatcacgttggccgggcaagtcaggcattagaaatgtattaggctggtatcagacaagaaaccgaaggaacgccctaagctctgatctatggngacatacgtaagttaaacgtcggtaccatacgagttcgaggcgagagtgatcgtggcacgagtacttcacttctacacatcacgacacgcctcgacacgtaccgtagtaagttacttttacgaactaacttttacttaaccgttagttaccttaacaacgtactacctaacgttaacttacgttacccggtagggtaccggttacccgggaaccggtaaacgggtaaaccgtaaacgggtaaggtaaaaccgtaacgtaaaccggttaacgtacgggtacggtcgtaacccgg

SEQ ID NO: 176700 - DNA, 499 bp, Homo sapiens
  misc_feature: GYAE6OF01B1WU7.13.48.E04.1.454.CMB.1.raw
  modified_base (226)..(226): a, c, t, g, unknown or other
  misc_feature (226)..(226): n is a, c, g, or t
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaatgatttaggctggtatcagcagaagccgagggagagtccctaaattattgatctctgctgcgtccgccttgcaatcgggggtcccatctcggttcagtggcggtggatctaggacagaattcactctcacatcaccacctnccacctgaagatgttagattatactgtacagtactatagtgtggcccncgtcgtagtttcggcggtacgggacgaaggtcgacgagactaccgaaacgtaactggtggcgtaccg

SEQ ID NO: 176701 - DNA, 685 bp, Homo sapiens
  misc_feature: GYAE6OF01BJMAH.13.48.E04.1.454.CMB.1.raw
  modified_base (208)..(208): a, c, t, g, unknown or other
  misc_feature (208)..(208): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccctagtcctccactccctccctgtctgctatctgtagganacagactaccaccatccacgttcggccggacaaggtcgagggactaagttaagaaatgtagtttaggctggtatcagacgaacgaaacgaaggaaccgaccctaagtcctactagactctagtggtcgactactaccgttaagttaaacggtcgggtaccctagtacgtaacgggttcggacggtacgtaggtcgtacgttcgtaggacctaacgtacgtactttacgtactttacctacctaccgtactacgaacgaccgtacgtccgtacgaccgtacgtacccgtaaggtaactttacgtttacgaacttaactttaacttaccgttagtaacctaaacgtaacgtactaccgtaaacttaacgtttaccgtcggttaccgggtaccggttaccgggaaccgtaaacgggtaacgtaaagggtaacgtaaacgaaccggtaaacggacgttacgggacgtccgttacgaacccg

SEQ ID NO: 176702 - DNA, 733 bp, Homo sapiens
  misc_feature: GYAE6OF01BPNS1.13.48.E04.1.454.CMB.1.raw
tcagtcacgtactacacgaccggtgctcgatttagagagcgtcacagagagaagggggcaggagtcagacccactcaggacacagcatggacatggacgggtcccccgctcagctccgtggggctcctgctgctctggcctcccaggtgccagatgtgccatccagatcgacccagtcctccatccctcctgtctgctatcgtgtaggagacagacgtccaccatcctacgttcggcccgggactaaggtcgagggactaagttaagaaatgtagtttaggcttaggtactcgagacgaacggaaaccgaaggggaaacctaccccgtaagtccttacgttagtacttacgttagtcggtacgtacctaacgttaaccggttaaaaggtttaaaacggccgggttaacctaagtaccgtaaggtcgacggaccggtagtaggtcggtaactcggtacggacctaacgtaacgttaccttacgtacttaccgtaccaacgtactaccgacgtacctaccgtccgtacgaccgtaacggtccgtaaggttaaacgtttacgttttaaccgaaccgtttaaacgtttaacgttaccgttacgttaacctaaacggtaacttaacgtacctaacgtttaacttaccgtccggttaccgggtaccggttaacccggaacggtaaacgggtacccgaaagggtaacgtaaacgtaacgaaacgtagtggtacgctaccg

SEQ ID NO: 176703 - DNA, 769 bp, Homo sapiens
  misc_feature: GYAE6OF01BBWRX.13.48.E04.1.454.CMB.1.raw
  modified_base (124)..(124): a, c, t, g, unknown or other
  misc_feature (124)..(124): n is a, c, g, or t
  modified_base (518)..(518): a, c, t, g, unknown or other
  misc_feature (518)..(518): n is a, c, g, or t
  modified_base (743)..(743): a, c, t, g, unknown or other
  misc_feature (743)..(743): n is a, c, g, or t
tcagtcacgtactacacgaccggtgctcgatttagagagcgtcacagagagaagggggcaggagtcagacccactcaggacacagcatggacatgagggtccccgctcagctccgtgggctccngctgctcgtggcctcccgaggtcgccagtatgtcgccactaccgacgagtaccgacccgtagtcctaccgactcccgtacccttgtccgtcgtcgttcctcgtacggacgacgacggtaccacctatcctacgttcggacggacaacgtcaagaactagttcggacctaactttacttaaagttgtactcgagacgtaaggtaacgtcgacgggaaccaacccggacccccgtaaccttccgaggtactaccggtacgtacctacgtccgttacgttcgacgtacgtaagtacggtaccctacccgtataaccggtaaggtttaccgaggtacggacctaaggtaactacgttaccggtaacggtaaacttaacggtttacccttttaaccccnccgtaaccgtacggtaccggtaacgggttaccctaacggtaccgtaccgtaaggtaacgtttcgtttaccggaaccttacttttaactagttaccgaacgtaacgtacgtttaacccgttccccgttacccgggttacccccggtaagtccccggaacgtaaccggaacggtaacggtagtaaccgaacgtaaccggaccgtagttcggtccgagtaccgacctntacgttcttcgttcctaccgttaccg

SEQ ID NO: 176704 - DNA, 585 bp, Homo sapiens
  misc_feature: GYAE6OF01DS4SW.13.48.E04.1.454.CMB.1.raw
  modified_base (200)..(200): a, c, t, g, unknown or other
  misc_feature (200)..(200): n is a, c, g, or t
  modified_base (579)..(579): a, c, t, g, unknown or other
  misc_feature (579)..(579): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctcctgtctgcatctgtagganacagatcaccatcacttgccggcaagtcaggcattagaaatgtatttaggctggtatcagcaagaaaccgtaagggaaacgccctaagctacttgatctatggtgctagtacctaaggtttaaaaggtcgggttaccctaagtacgtaaggtttcaacggtcggcaggtcggtatcgtacggctaacgacgtacttactacttactacaaccatcaacgccacgcctagacagacctaggtaagttacttttacgacttaaacgtttacttacgttacgtactaacgtaaatacgtactaacttaacgttactaccgttcgggtaaccggttccggaaggaacggtaacgaagggtagaaactacgaaacgagtgtcgngtaccg

SEQ ID NO: 176705 - DNA, 523 bp, Homo sapiens
  misc_feature: GYAE6OF01E0NJR.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccgagggaaacgcccctaagctcttgatctatggtgcatccaagtttaaaagtgggtacccatcaaggttcagcggcagtgatcgtggcacagtacttctattcctacaccatcagtcacgcctgcacgcctagaagtattttcgactaacttattactgtactacaagtatacaatattatccgtagggtaccgttcggaccgtaagggaccaagggtaggaaaactaccgaaaacgtaagtcgtggcgtacg

SEQ ID NO: 176706 - DNA, 652 bp, Homo sapiens
  misc_feature: GYAE6OF01EDTXK.13.48.E04.1.454.CMB.1.raw
tcagtcacgtactacacgaccggtgctcgattttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtcaccatcacttgccaggcgagtcaggacattaacaacttatttaaattggtatcagcaagaaaccaggtaaacgcccctaagcctacctgatctacgatcgcattacctaagttttacggaaacgtacggggtcccctaagtaccgtaaggtttcaaggtagggaagttggatcgtaggggaactaggttactttttacttcaacctactacgagccgtagtcccgttagacctacgacccgttaggtaaacgtatttacttcggaacctaaacgttattaatttaccgttagtacacggtactaaggttactagtaacttaactcccgtacccgtacgtaccccttaaccggtttccggaacccgtaaacggggacctaacggtacccgttaaggggaaacgttaaacggttaaaccggtaaacgttcgggtacggtaccg

SEQ ID NO: 176707 - DNA, 679 bp, Homo sapiens
  misc_feature: GYAE6OF01C4ZHK.13.48.E04.1.454.CMB.1.raw
  modified_base (305)..(305): a, c, t, g, unknown or other
  misc_feature (305)..(305): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtagagacagagtcaccatcacttgccgggcaagtcaggcattaagaatgtatttaggctggtatacagcaagaaaccgaaggaaacgccctaagctctgatctagtggtnctataccgaagtttaaaagtcgggtaccagtacgaaggttacgaggtcggacgtagtggatcgtaggaccactacggtaacctttcgactttacctacctaccctataccgaacgccaacggtccgtacgaccgtaacggtcccgtaaggtaacgttacgtttttacgaaccgtttaaactttaactttaacgttacgttacctaaacgtaaacggtaacttaccgaaacttaaactttaaccgttacccggttacgggggttaacccggtttacccggggaacccggtaaaacccgggggtaaccgaaaccgggtaccgttaacggggtaaacgtaaccgtaaccgtaaacgggaccggtaaccgttacgggg

SEQ ID NO: 176708 - DNA, 619 bp, Homo sapiens
  misc_feature: GYAE6OF01BDBC0.13.48.E04.1.454.CMB.1.raw
  modified_base (353)..(353): a, c, t, g, unknown or other
  misc_feature (353)..(353): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttggccgggcaagtcgagggcattaagaatgatttaggctggtatcagcaagaaaccgagggaaacgccccgtaagctcttgatctagtgtgcatactaagtttaaaagcgggtaccagtactaaggttcagcggngaggtggatcgtggcacgagtacttctacttcctacacctatcacgcacgcctagctacgcctaggtaacgttacttttacgacttaacgtttaattaccgttagttaaccttaacgtaaagtacttacctaaacttaactttacgttacccggtacggggttacccggttaccgggtaacccggaaacggggtaaacccgtaaaggggttaaggaaaaccttaaccgaaaaccggtaacgttacggttaccgggtacgtaaccgg

SEQ ID NO: 176709 - DNA, 528 bp, Homo sapiens
  misc_feature: GYAE6OF01BM8Z9.13.48.E04.1.454.CMB.1.raw
  modified_base (226)..(226): a, c, t, g, unknown or other
  misc_feature (226)..(226): n is a, c, g, or t
  modified_base (346)..(346): a, c, t, g, unknown or other
  misc_feature (346)..(346): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaaatgatttaggctggtatcagcagaaaccagggaaacgcccctaagctcttgatctatggtgcatcctaagtttaaaagtggggtcccatcaaggttcagcggnagtggatcgtggcacagacttcattctcacatcagcacgcctgcagcctgaagtntttgctaactttattactgtactaanaagatacaactaatttactcccgttaggggtaccgttccgggacccgaaacggggtacccaaagggtacggaaataccgaaacgaacgtggtggctaccgg

SEQ ID NO: 176710 - DNA, 697 bp, Homo sapiens
  misc_feature: GYAE6OF01EMK75.13.48.E04.1.454.CMB.1.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtctccatcctccctgtctgcatctgtaggagacagatcaccatcacgttcgccgggacaagtcgagggacaattagaaatgtaagtttaggctggtacncagacaacggaaaccgaggggaaacnccccgtaagcttacgtagatctagtcggtagactacgtaccgtaaaggtttaaaaacggtcgggtaccctaagttacgtaacggttacaaggcggtacgagggttacggtacttacgtcggactacgtacgtaccttactacgttcctaccaacctatccaggtaccacgccgtcggacgaccgtaccgttaggtaaacgtttacttttacggaacctttaacgttttaacttaccgttacgttacctaaaccgaaagttacctacgtaaacctaaggtttaccttacccgggtagggttaacccgggttccggtaacccgggtaaacggggtaccgtaaaacgggtaacggtaaaaccgttacccgaaaacgggttaacgtcgggtaggtcctaacccgg

SEQ ID NO: 176711 - DNA, 632 bp, Homo sapiens
  misc_feature: GYAE6OF01ECKGH.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtcctccatccctccctgtctgcatcgtgtaggagacagacgtaccaccatccacgttcggccggacaaggtcgagggactaagttaagaagtagtagtttaggcttaggtactacgagacgaacgaaaccgaaggggaaacctaccccgtaagtccgttacgtagtacttactagtggtactacgtaactaccgtaaaggtttaaaacggtcgggtaccctaagtaccgtaaggttacgacggcggtacgtaggtcggtagttcggtacggtaactagtttacttttacctactacctatcgacgtacgacgactgacgcgtacgtacgaatatatcgaactaatattaacgttcgtagtacagtacagtatacgtaacttactccgtaccgtatccgtacccgttaggaccgtaagaccgtaccggagtacggtaacgtaagttaaacggtgtaggtacg

SEQ ID NO: 176712 - DNA, 692 bp, Homo sapiens
  misc_feature: GYAE6OF01BT422.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtcctccatccctccctgtctgcatctgtaggagacagacgtcaccatcacttcggccgggacaagtcgaggcaattaagaaatgtatttaggctggtatcgagacgaagaaaccgacgggaaacgacccgtaagctacgttgatactagtggtgactactaccgtaaaggtttaaaacggtcgggtaccctaagtacgtaacggttacgacggacggtacgtaggttacgggtacgttcggtacgggacctaacggtaacgttacctttacgtaactttaccgtacctaacccgtaacgtaccgaacgtaccgacgtcccgtagaccgtaacgtcctaaggtaacggtttactttacgtaccttaaacttttagttactacgttacctaagtaacgtactaacaacttaagttaccgttccggtacggggttacccgttaccggggaacccgtaaacggggtaccgaaagggttaacggaaacgttaaccggaaacggttaacgtacggtggtagtacccgg

SEQ ID NO: 176713 - DNA, 706 bp, Homo sapiens
  misc_feature: GYAE6OF01EB53M.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagttcgacccagtcctccattcccttcctgtctgcatctgtaggagacagatcaccatccacttggccgggacagtcaggacattaacagtttattgtctggtatcagaacaaaaccgaggtaaactcctaacgctaccgtgacttactatggttcactactcctactttagacgtaacgggtcgggtaccctagtacgtaaggttcgacgggcggtacgtaggtggtacgtacggtagggaactaagtacttaccgacgtactaccgaactaactacgaacgactaccgtcccgtacgaccgtacggtaccttaggtaaacttttcgtttacgaactttaaccgtttaattaccgttaacgtaaccaacttacgttaacctttaacgttaccccggttaccctacccgtttacggttacccggggtttacgggaaacccgggggttaacggtaacccgggttaaaggggtacggtaaacggtaaccgttaaccgaaaaccgggttacggttacgggtacggtaccgtaccggtaccttaaccccgg

SEQ ID NO: 176714 - DNA, 742 bp, Homo sapiens
  misc_feature: GYAE6OF01CYS5O.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctccgtggggctcctgctgctctggcctcccaggtgccagatgtgccatccagatcgacccagtcctccactccctcccgtgtcctgctactcgtggtaaggagaaccaggtaactccaacctatccgtaaccgttcggaccggggcaaaggtccgaagggctaagttaagaaatgtaacgtttaggcgttggtatacgaacgacgaaaacggaaacccggaaacgggaaaaccgtacccccgtaaagtccgttaccgtttagactttaccgttaagttggggtacactaacgttaacccgttaaaggttttaaaaaccgggtcgggttaacccctaagttacggtaacggttcgaaggccggacgtaggtcggtatccggtacggactaacgacgtacctttacctattccacctaaccgtactacgacgtaccgaccgaccgttcgacccgtaagacccgttaggtaaactttcggttttacaacttaacctttacgttaacgttacttaccaagtaactacgtacctaattaacgttaaccgtacggtcgggtaaccggttaccgaacgggaaacggtaacgtaaggtaaaacgttacgaaaccgtaaagacggtagtcggtcctacgg

SEQ ID NO: 176715 - DNA, 873 bp, Homo sapiens
  misc_feature: GYAE6OF01EQQ9H.13.48.E04.1.454.CMB.1.raw
tcagtcacgtactacacgaccggtgctcgatttagagagcgtcacagagagaagggggcaggagtcagacccactcaggacacagcatggacatgagggtccccgctcagcctcctggggctcctgctgctctggctcccaggtgccagatgtgccatccagatcgacccagtctccatccctccctgtctgcatctggtaggagacagacgtccaccatccacgttcggccgggacaaggtcgagggacctaagtttaagaaaattggtaattttagggacttagggtatccgaagaccaaacggaaaacccgaagggggtaaaacccgacccccgtaaaggtccgtttaccgtttacggtaacttaccgttaagtcgggttacgacccttaagttaacccgttaaaaagggttttaaaaacggggtccggggtacccctaagtacggtaaggttacgacgggtaccggtacgtaggttacggacgttcggtacgggactaacgtacgttaccttacttacttacctacgtaaccctaattaccgaagccgtaaccgtcccgtacgaacccgacggttaccctaaggttaaaacggttttcttttacgggaaaccctttttaaacgttttaacgtttaacccggttacgtttaaaccccgtaaaacgttaaaccgttaaccgtaaacccttaaaacggttaaaccgtttttaaccgggttaaccccgggttaacgggggttaaaccccgggtttacccgggaaacccgggtaaaacggggtaaaccccggttaaaaggggtaaacccggttaaaacgtaacccggtaaaaaaccggttacggttacgggttaccggaaccggtttaaacccg

SEQ ID NO: 176716 - DNA, 707 bp, Homo sapiens
  misc_feature: GYAE6OF01D0KG7.13.48.E04.1.454.CMB.1.raw
  modified_base (212)..(212): a, c, t, g, unknown or other
  misc_feature (212)..(212): n is a, c, g, or t
  modified_base (354)..(354): a, c, t, g, unknown or other
  misc_feature (354)..(354): n is a, c, g, or t
tcagtcacgtactacacgaccggtgctcgatttagagagcgtcacagagagaagggggcaggagtcagacccactcaggacacagcatggacatggacgggtccccgctcagctccgtggggctcctgctgctctggcctcccaggtgccagatgtgaccatccagatgacccagtcctccactccctccctgtctgcattcgtagtagganacaggatccaccatcctacgttggcccgggacaaggtcgagggacctaagttaagaaatgtatttaggcttaggtatcgaagacgaaagaaaccgaacgggaaacgtaccccgtaagcttacgttagattacgtagtcggtnactaacgtaccgtaaaggtttaaacggtcgggtacctaatcgtaaaggtcaacggtcggacgtaaggtggtactcggtaggtaaccaacgtacgtaacctttcctactttacccgtaataacccctaatacgaacgtcgaccgtccgtacggaccgtaccggtcttaacggtaagtttacgtttaacgaactttaacgttttaactacggttacttaacctaaagtaactacttaacctaacgttaactttacgtcccggttaagggtacccggttaccggaacccggaaacgggttaacggaaacgggttaagaaaacgttaccgaaaacggtacgttggtaacgtctacgg

SEQ ID NO: 176717 - DNA, 615 bp, Homo sapiens
  misc_feature: GYAE6OF01A2MXE.13.48.E04.1.454.CMB.1.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (349)..(349): a, c, t, g, unknown or other
  misc_feature (349)..(349): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaatgatttaggctggtatcagcagaaaccgagggaaacnccctaagctctgatctatggtgcatccaagtttaaaacggtcgggtaccatcgtaaggttcaggcgganagtggatctggcacagtacttcacttctcacatcagcacgcctgcacgcctagaacgttattttcgaacttaactttaacttacgttacgtacttaacgaaagtacttacaacgttaactttacgttacccgttacggggtaacccggtttccggggtaacccgtaaacgggggtaacccgtaaaacggggttaacgggtaaaaaccgttaaaccggtaaaaaccccgggtaaacgttacgggttaccggggtacccgtaaccggg

SEQ ID NO: 176718 - DNA, 965 bp, Homo sapiens
  misc_feature: GYAE6OF01B5CLB.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtctccatccctccctgtctgcatctgtaggagacagacgtacaccgatccacgttcggcccgggacaaggtccgagggactaagttaagaaagttgtaagtttaggcttaggtactcgaagacgaaacggaaaccggaacggggaaaccgccccgtaaagtccttacgttagtacttacgttaagttggtacgtactaacgttaaccgttaaaaggtttaaaaacggggtccgggttaacccctaacgttaaccggtaaacgggtttaccgaacgggtacccgggtaacgttaacgggggttacgggtaaccgtttaccgggtacgggtaccccgtaaaccggtaacggttaaccccttttaaccgtaaccgttttaccccttaacccctaaaccccgttaaccgttacccggaaccggttaccccggtaacccggtaccccggttaacggtaacccccgtaaccgggtaccccggtttaaagggttaaaaccggtttttaccgtttttaaccgtaacccgttttaaacctttttaaaccgttttacccgttaacgtttaaacccgttaaactaaaccgggtttaacccttaaaccgttaaaaccgtttaacggtttttaacccggtacccgggtttaaccgggggggtaaacccccgttttacgggggaaaccccgggttaaaacccgggggtaaacccgggtaaacgggttaaaaccgggtaaaaccgtttaaaaccccgggaaaaccgggtttaaacccggtttcgggttaacggtcccggttaacccggg

SEQ ID NO: 176719 - DNA, 623 bp, Homo sapiens
  misc_feature: GYAE6OF01CL2X0.13.48.E04.1.454.CMB.1.raw
  modified_base (292)..(292): a, c, t, g, unknown or other
  misc_feature (292)..(292): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtccacatcacgttggccggcaagtcgaggctaattaagaatgtagtttaggcttggtatcagacaacgaaaccgaagggaaccncccgtaagctcgttagtatctagtggtcgctacgtacgtaagtttaaacggtcggtaccctagtacgtaaggtcaggacggcgtagtggtactcgtcgacacgtacgtacttctacttcctacgacctatacgacgacctacgccctagacctacgtcctaaggtaagttactttaccgacttaactttactacgttacgtactaacacgttactacgtaacttacgttacgtaccggtacgggtaccgttaaccgggacctaaacggggtaacccttaaagggtaaccgtaaacgtaccgtaaacggttacgtacggtgtaccgtaaccg

SEQ ID NO: 176720 - DNA, 763 bp, Homo sapiens
  misc_feature: GYAE6OF01DIX0C.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggcctcccaggtcgccagatgtgccatccagatcgacccagtcctccatccctccctgtctgcatctgtaggacgacagacgtcaccatcctacgttcggccgggacaaggtcgaggctaagttaagaaatgtaagtttacggcgttaggtaactcgaaggaccgaaacgaaaaccggtaaacggaaaaccgtccccgtaaaggtccttaccgttaggtactttacgttaaggttcgggtacgacctaacgtttaacccgttaaaagggttttaaaaaccggggtccggggttaaccctaacgtaacgtaagggttaccgacggacggtacgtagggtacgggtatccggtacgtacacgtacgttaccttacgtacgttttaccaccgtaaccctagtcgaacgtccgaaccgtcccgtagccgtacgtaccgttaggttaaagttctttaacgtactttaaacctttaacgttaccttacgtaccttaacgaacgttactaccttaaaccgtaagtttaccgtaccgggttacgggtaacccggttaccgggaaaccggtaaacgggtaacggtaaacgggtaagtaaaccgttaaaccgaaaggtacgttacgggtcggtcgtaaccg

SEQ ID NO: 176721 - DNA, 749 bp, Homo sapiens
  misc_feature: GYAE6OF01D0X3F.13.48.E04.1.454.CMB.1.raw
  modified_base (133)..(133): a, c, t, g, unknown or other
  misc_feature (133)..(133): n is a, c, g, or t
  modified_base (610)..(610): a, c, t, g, unknown or other
  misc_feature (610)..(610): n is a, c, g, or t
tcagtcacgtactacacgaccggtgctcgatttagagagcgtcacagagagaagggggcaggagtcagacccactcaggacacagcatggacatgagggtccccgctcagcctccgtggggctcctgctgctntggctcccaggtgccagatgtcgaccatccagatcgacccagtcctccactccctccctgtctgcatctggtaaggagacagacgtccacctatcctacgttcggaccgggactaaggtcggaacgggtactaaagtttaaaggaaagttggttaagttttacgggcgttaggttaactccgaacggaaccgaaaacggaaaaaccgaacggggtaaaaccgtacccccgtaaagtccctttacgttagtacttacgtaagttcggtacgactaacgttaacgttaaaaggtttaaacggtccggtacctaagtacgtaaggttcaggcgtcgaggtggtactcgtacgtaccaacgtacgttacttacctactttaccgaccaacgtactacgacgccgtacgtccaggtacctacgtcgtaaggtaatttactttacgtaacttaaacttacgtttaacgtagttaaccgtaaanaacgttaactaccgtaactttaacgttcccgtaccgggttaacgggtacccggttaacgggaaccggtaaacggggtaaacgaaccgggttaagaaaaaccttaccgggaaaacgttcgttacggtcggtccgtaaccg

SEQ ID NO: 176722 - DNA, 729 bp, Homo sapiens
  misc_feature: GYAE6OF01BSJEX.13.48.E04.1.454.CMB.1.raw
  modified_base (203)..(203): a, c, t, g, unknown or other
  misc_feature (203)..(203): n is a, c, g, or t
  modified_base (328)..(328): a, c, t, g, unknown or other
  misc_feature (328)..(328): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctcggctcccaggtgccagatgtgccatccagatcgacccagtctccatcctccctgtctgcatctgtagganacagacgtccacctatcctacgttcggccgggactaacggtcaggggactaagttaacgaaattgtaagtttacggccgttggtaactcgaacgtacgaaaacggaaacccggaaggggaaaccncccgtaagcgtttacgttacgaacttacgtagtcggtactaacctacgttaacccgttaaaagggtttaaaacggtccggggttaccctaagtaacggtaacgggtttccgaacggtacgggtacgtagggttacggtacgttacggtcggacaaccgtaacggttaccttacgtacgtttacctaccctaacctatacgaacgtcgacgtccctagcgtactacggtacgttaaacgttactttacgtaccttaactttaacgttaccgttataaccgtaactaaacgtactaccgtaacgttaaacgtcgttaaccggtaggggtacccgttaccggaaacccggtaacggaaccgtaagggtactaaaccgtacgaaacgtacggtgtccgcgtaacg

SEQ ID NO: 176723 - DNA, 635 bp, Homo sapiens
  misc_feature: GYAE6OF01D039S.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagatcaccatcacgttgccgggacaagtcgagggcaagttaagaaatgtaatttaggctaggtatcagacaagaaaaccgaagggaaaacgacccctaaagcttacttagactctacgatgactatacctaagtttacggaacgacggggtacccaatacgtaaggttcaaggtggaagtggatcgtaggactagtacttttacgttacaccgatcgaagcacgaccttgacacgtcctagaacgtattagttgaacctaactattaacttacttcgtaactaactaagactacgactaaattaccttaccggttacgggtaaccgtttccgggaaacccggtaaaggggtaacccgtaaaaggggtaaacggtaaaacgtaaacccgtaaaaggtaaaacccgttgggtaaccggtcgtacgaaaccccg

SEQ ID NO: 176724 - DNA, 657 bp, Homo sapiens
  misc_feature: GYAE6OF01BM40N.13.48.E04.1.454.CMB.1.raw
  modified_base (200)..(200): a, c, t, g, unknown or other
  misc_feature (200)..(200): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctcctgtctgcatctgtagganacagagtcaccatcacttggccgggacaagtcgagggcattagaaatgtatttagctggtatcagcagaaaccgaggaacgcccgtaagctactgatactagtggtgacactacgtaagtttaaaacggtcgggtaccctaagtacgtaaggttacgaggtcggacgtaggtaggtacgtcgtaggaccaacgtacgtaccttacgtactttcctaccgaacctactaccgtacgactacggtaccctggacctacgtccgttaagtaacgtttagttttacgaacctttaaacgtttacttaaccgtcgttactaacgtaagtacttaacaacttaaacttacgttcccgggttaaggtacccgggttaccggaacccgggtaaacgggaacccgttaaacgggtaacgtaaaacgtaccgaaaacggtaaccgttacggtacggtaccgtaccgg

SEQ ID NO: 176725 - DNA, 603 bp, Homo sapiens
  misc_feature: GYAE6OF01B7YWB.13.48.E04.1.454.CMB.1.raw
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtcctccatccctccctgtctgcatctggtaggagacagagtccaccatcacgttcggcccggganaagtcgagggctaattaagaaatgtatttaggctggtatcagcaagaaaccgagggaaacncccctaagctcttgatctatggntcatacgtaaggttaaaagtcgggtccagtcgaaggtcagcgntaggtgatcgtgnacagtacttctacgttcncacctatcacgcacgcctgacacgctagaattcgtttacgacttaacgtttacttacgttcgttaacgtaacgtaagttactaccgtaaattaacgtttactcccggttacgggggtacccgttaccgggaacccggtaacgggtaaccggtaaagggtaaccgaaaagtaccgtaaaaccggtactacgggttccgggcgttaaccgg

SEQ ID NO: 176726 - DNA, 756 bp, Homo sapiens
  misc_feature: GYAE6OF01AMI1Q.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctccgtggggctcctgctgctctggctcccaggtgccagatgtcgccatccagatcgacccagtcctccactccctccctgtctgctatcgtggtaggagacagacgtccaccatcctacgttcggccgggacaagtcgagggactagttaagaatgtagtttaggctggtatcgagacgaacgaaaccggaacgggaaaccgtaccccgtaagtccgttacgtttagtacttacgtagttcgggtacgtacgtaacgttaacccggttaaaaggttttaaaaacgggtccggggtaaccctaacgtacggtaacggttaccgacggcggtacgagggtcgtacgtccggtagcctaacgtacgtaccttactacttcctacctactactaccgacgtaccgtaccgtcccgtacggaccgtaacggttacccgtaaggttaaacgtttctttaacgtaaccctttaaactttaacgtttaccgttacgtacttaacgaagtacctaaccttaacttaacgttaccgttacccggttacgggttaacccggttacgggaaccggtaaaccggggtaacgtaaaccgggttaaacggtaaacgtaaaccggtaaaccggttacggttccggtaggtcccgtaaccgg

SEQ ID NO: 176727 - DNA, 662 bp, Homo sapiens
  misc_feature: GYAE6OF01D98DA.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctccgtggggctcctgctgctctggctctcaggtgccagatgtgacatccagatgacccagtctccatcctccctgtcctgctatctcttggagacagagtccacccgttcaccgttcggccgggacgtagtcacggaactaacttaaacctaactttactttacgtccttggttatccgagcaggaacgccggaaggggagaacgttacccgtaaatttatagtactctctgcttcggtccgttcccgtccgttctaccggtaacggttcccgggggtccctacgttcttccgggttcgtacggtcggggtcgggtagggtacgtacgtaaggtactaaggtaacttccgtacctctaccacctaactaccaaccctaaacctcgacctaaccccgtaagaacgtagttagggttacgtaagttttactaacgtcgtaacacgtaacctagttcggtacggtccgacccgttcgtcgttacgtttcgggacgggtacggaacgtagtcggcaacgtacgtacgtaaacgacgtggtcgtcgtcgtaacccg

SEQ ID NO: 176728 - DNA, 778 bp, Homo sapiens
  misc_feature: GYAE6OF01EH0QS.13.48.E04.1.454.CMB.1.raw
  modified_base (235)..(235): a, c, t, g, unknown or other
  misc_feature (235)..(235): n is a, c, g, or t
tcagtcacgtactacacgaccggtgctcgatttagagagcgtcacagagagaagggggcaggagtcagacccactcaggacacagcatggacatgagggtccccgctcagcctcctggggctcctgctgctctggctcccaggtgccagatgtgccatccagatgacccagtcctccactcctccctgtctcgcatcgtgtaggagacagacgtcaccatcacgttcggaccggnaacgtcgaggacattaagaatgtaagtttaggcgttaggtatacgacgacgaaacggaaaaccggaacggggaaaaccgtaccccgtaacggtactttaccgttacgtaacgttacgttagttacgggttacgtaccgtaacgttaacccggttaaaaggtttttaaaaaaccggggtccgggggttaaccccctaacgttaacccgggttaaacgggtttacgaacgggtaccgggtacggtaggtcggtacgtccggtacgggacctaacgtacgttaaccttaccgtactttaccgtaacctacctaactaccgaggtaccaccggtccgtcggacctcgtaccgttaggttaacgttacgttttacgaacctttaaactttacgtttaccgttagttactaaacgtacgtaactactaaaccgttagttacgttacccgggtacggttaaccggtacccgggaaccggaacgggtaaaccggtaaaggttacggtaaaacctaccgggtaaaccgttaggttacggacggtacgtaccg

SEQ ID NO: 176729 - DNA, 611 bp, Homo sapiens
  misc_feature: GYAE6OF01BG05K.13.48.E04.1.454.CMB.1.raw
  modified_base (368)..(368): a, c, t, g, unknown or other
  misc_feature (368)..(368): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaatgtattaggctggtatcagcagaaccgaggaacgcccagctcttagatctatggtgctactaccgtaagtttaaaaggtcgggtaccaagtcgtaacggttcgaggacggcgtaggtggattcggnggcaacgacgtacttacactttctaccacctatccgagaccacggtcctgaccgacgtccgtagtaaacgttgtttaacgaccttaaacttttaactttaccgtggttaacctaacgtaacgtacttactaacttaacgtttaccgtaccgtaccggggtaacgttccgggaacccgtaacggggtaaaccgaaggggtacgaaaacgttaacaaaacggtaatcgggtacgtacgtaaccgg

SEQ ID NO: 176730 - DNA, 801 bp, Homo sapiens
  misc_feature: GYAE6OF01D1ELM.13.48.E04.1.454.CMB.1.raw
  modified_base (793)..(793): a, c, t, g, unknown or other
  misc_feature (793)..(793): n is a, c, g, or t
tcagtcacgtactacacgaccggtgctcgatttagagagcgtcacagagagaagggggcaggagtcagacccactcaggacacagcatggacatgacgggtccccgctcagcctccgtggggctcctgctgctcgtggcctcccgaggtcgaccagtagttgtcgaccctatcccgaaggactccgacccctagtcctaccctacttccccgttccctgtctcgactacttcgtaggtaacggagaacgaagtaccgtaccaacctactaccgtaccggttccgggacccggggacgtaacggtcggaacgggacctaaagttaaggtaaagttgttaagtttaggaccgttaggttaacgacgacgaaccgaaacggaaaccggaacgggaaacccgtacccctaacgtcgttacgttacgtacttacgttagtggtacgacttaacgttaaccggttaaaggtttaaacggtccggtaacctagtacgtaacgtcgacggtacggtacgtaggtacggacgttacggtacgtaccgtaacgttaacgtacctttactacgttacccgtaccaccgtactaccgacgtaccgaccggtcctacgtcgtaccgtacgttaacggttaactttagttaccgtaactttactttaaccgttacgtacgttaacaacttaacgtactaactaacctaacgttcgtacccggttacgggttaaccggtaccggaacggttaaacgggacggttaaagggtaacctaaacggtaaacgaaccgtaggttacggtaccnccggtacg

SEQ ID NO: 176731 - DNA, 643 bp, Homo sapiens
  misc_feature: GYAE6OF01CB0SR.13.48.E04.1.454.CMB.1.raw
  modified_base (248)..(248): a, c, t, g, unknown or other
  misc_feature (248)..(248): n is a, c, g, or t
  modified_base (324)..(324): a, c, t, g, unknown or other
  misc_feature (324)..(324): n is a, c, g, or t
  modified_base (514)..(514): a, c, t, g, unknown or other
  misc_feature (514)..(514): n is a, c, g, or t
  modified_base (636)..(636): a, c, t, g, unknown or other
  misc_feature (636)..(636): n is a, c, g, or t
tcagtcacgtactacacgaccggtgctcgatttagagagcgtcacagagagaagggggcaggagtcagacccactcaggacacagcatggacatggacgggtccccgtctcagcctccgtggggctcctgctgctctggcctcccgaggtcgccagatgtcgccatccagatcgacccagtcctccactccctccctgtctgctatcgtgtaggagacagacgtcaccatcgacttcgggaccggganacgtcgagggctaagttaagaaattggtaagtttaggctaggtatacagaccaacggaaaaccggaggggaaaccnccccgtaagtccttacgttagacttacgtagtggtacgactacgtaaccgtaaaggtttaaaccggtcggtacctaagtacgtaacggttcgacggcggtacgtaggtcggacttcgtacggactacgtacgttaccttctacttcctaccactagtcgacgctacgcctagcacgtccgtagtaacttntttacgaacttaagttacttacgtagttacctaacgaatactactaattacgtcgtaccggtaggtaccgtacggacgtaacgggtacgtacggtaagaacgtaaccgaacgtcgtggtcgngtacccg

SEQ ID NO: 176732 - DNA, 810 bp, Homo sapiens
  misc_feature: GYAE6OF01BPMO6.13.48.E04.1.454.CMB.1.raw
tcagtcacgtactacacgaccggtgctcgatttagagagcgtcacagagagaagggggcaggagtcagacccactcaggacacagcatggacatggacgggtccccgctcagcctccgtggggctcctgctgctcgtggcctcccgaggtcgccagtatggtcgcctatccagactcgacccagtcctccacttccctccctggtctgactacttcgtaggtaacgggacgacgtaggtacctaccaaccctacgttccgtaacggtttccgggacccggggtaactaaacggggttccggaacggggtaccttaaagtttaacggaaaaagttgtttacggtttaagggccgttagggtactacggaaccggtacgaaacggaaaaccggaggggtaaaaccctaccccgtaagtctttacggtattacgtacgttagttcgggtactactaaaccgtttaaccggttaaaaagggttttaaaccggggtcccggttaaccctaaacgttccgggtaaacggttccgtaacgggcggtacgtaacgggtggtaccttggaccggtacctaggtaccgttactccgttattccccgtactaacccgtactaccgaatcccgtaacgtccctacggtaccctaggttaccgtaggtaacgtttacttactaacgttaactactttcgtacttactaagtaactctacgtaacttacgtagttcccggacgggtaccgtaccgggaacgtaacgggaacccgtagggaaaccgtaactaacggtaaacccgtagttacggcggttctaaccg

SEQ ID NO: 176733 - DNA, 917 bp, Homo sapiens
  misc_feature: GYAE6OF01A87II.13.48.E04.1.454.CMB.1.raw
  modified_base (256)..(256): a, c, t, g, unknown or other
  misc_feature (256)..(256): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgacatccaggttcgacccagtcctccatccttctgtctgcatcgtgtaggagacagagtccacatcacgttcgccggcagtcaggactattaacagttattgtntggtatacagaccaaaacgtaggtaacgtacctaacgctccgtagtacttactagttagttcgacctacgttcctacttttacgacgtaaacgggttccggggtaaccctaggttaccgtaacgggttaccgagggtacccgggtaccggtaagggttacggtaaccgtttacgggttaacggggtaacccgtaaagggttaaacccttttccgtaaccctttcccgtaaaccctaacgtaacgttaaccccgtacggtaacccgtaccggtaaaccccttcggggtaacccgtaaccggtacccggttaacggtttaacgggtttaaccctttttaggggtaaccccttttaaaccggttttaacctttaacccggtttaacgggttaaaccctttaaaacgggttaacccgtttaaccgttttaaaaccggtttaccccggtttaacccccggttaagtttaccccggggttttaaccgggtttcccggggggggaaaccgggttaaacccggggggtaaacccggtttaaaggggggttaccggggttaaaacccgggttaaccggtttaaaaaaccccgggaaaccggtttaaaaccgggtttaccgggggttaacggtaccccgggttaaccggtaaacccccggtttaacccggg

SEQ ID NO: 176734 - DNA, 717 bp, Homo sapiens
  misc_feature: GYAE6OF01EAQZ4.13.48.E04.1.454.CMB.1.raw
tcagtcacgtactacacgaccggtgctcgattttagagagcgtcacagagagaagggggcaggagtcagacccactcaggacacagcatggacatgagggtccccgctcagcctccgtggggcctcctgctgctctggcctcccaggtcgccagatgtgccatccagatcgacccagtcctccactccctccctgtctgcattcgtaggtaggagaaccagactccacctactcgtacgttcggccgggacaaggtcgagggtactaagttaagaaatggtaagtttaggcgttaggtactcgagaccgaaacgaaaccggaacggggaaaccgtaccccgtaagtccttacgttagtattccgtagtcggacgtacgtaacgttaaccgttaaaaggtttaaacggtccggtacctagtacgtaacgtcgaggccgagtagtgtactcgtacgacaactacgtacctttacgtcttacctacctaactactacgacgacgtaccgccgtacgactaccgtacgtagttaagtttcgtttacgaacctttaattaccttacgtacgttaactaacgtaactacttaaccgttaaactaaccgtttaccggttacccgggttacgggttaacccggtaccggaaaccgggaaacgggtaccggtaaagggtaacgaaacccgttaaggtaaacccggtagttccgggtgccgtaaccg

SEQ ID NO: 176735 - DNA, 758 bp, Homo sapiens
  misc_feature: GYAE6OF01BBL9I.13.48.E04.1.454.CMB.1.raw
  modified_base (537)..(537): a, c, t, g, unknown or other
  misc_feature (537)..(537): n is a, c, g, or t
  modified_base (619)..(619): a, c, t, g, unknown or other
  misc_feature (619)..(619): n is a, c, g, or t
tcagtcacgtactacacgaccggtgctcgatttagagagcgtcacagagagaagggggcaggagtcagacccactcaggacacagcatggacatggacgggtccccgctcagcctccgtggggctcctgctgctctggcctcccaggtcgccagtatgtcgccactccagatcgacccagtcctccactccctccctgtctgttactctggtacgagacacgacgtaccacctactaccgtacgttcggaccggacaacggtcggagggtacttaagttaaaggtaagttacggtaagtttacgggtcttacgggtactacgaacggtaaccgaaacgggtaaaacccggaacgggaacccgtaccccgttaaagtccttacgtttaacgactttacggttacggtacgtacgaacctaacgttaaccgttaaaacgggtttaaacgggtccgggtaacctagttacgaacgggttacacgggacggtcgtaggtgtactcgtacggaacacgtacgttacttacgacttcgaaccnctaagtcacgactcgtacgcacgtacgtacgtagttaactacgttcgtaaccttagtttaactacgttacgtaaccctaaanacgttataacccggtaattacccggttcgttaacccggttaccgggtaaccggttaccggaaaccgggtaaaccgggtaaggttaacgggaataaacccgttaacccgaaagggttcttagggcctagtccccgtaacg

SEQ ID NO: 176736 - DNA, 817 bp, Homo sapiens
  misc_feature: GYAE6OF01BZ7GU.13.48.E04.1.454.CMB.1.raw
  modified_base (153)..(153): a, c, t, g, unknown or other
  misc_feature (153)..(153): n is a, c, g, or t
tcagtcacgtactacacgaccggtgctcgatttagagagcgtcacagagagaagggggcaggagtcagacccactcaggacacagcatggacatggacgggtccccgctcagctccgtggggctcctgctgcctcgtcggcctcccgaggtcncagtactgtcgacctatccgaggactacgaccctagtcctaccacttccctccctgtcgtcacgtactcgtaggtaggaacgaacgaggacgtaccaaccgtacttaccgtaccggttcggaccgggtacgtaaacggtcggaacggtaacttaagttaaaaggtaaacggttagtaaggtttaggacggttaaggttaacacggaacggaaccgaaacggaaaaccgtaacggggtaaccctaaccgtacggtaccttacgttacgtacttacgtaaggtcgactaattaacgtaacgttaaaagggtaaacggtccgtacacgtaacgtaggtacgtaggacggtagtaggtactaggtagtaacgttacgttactttacgtaccgaactcgtaacgacgtaacgtctaccgtacgacggtaaccgtacggtaaggtaaactacgtaaagtaccgtaaacttaacgttttaaacgttcgtaacgttaaccggtacgtaaacgttaagggttaaacttaacggtaccgtttaaaaccttcccgtaacccggtaccttaaccggttaacccggtacccggtaaaccggaaacggtacggttaaacccggacttaagggaaaccttaacggttaaaactaacggggtctacggggtaactacccg

SEQ ID NO: 176737 - DNA, 666 bp, Homo sapiens
  misc_feature: GYAE6OF01E1C2W.13.48.E04.1.454.CMB.1.raw
  modified_base (326)..(326): a, c, t, g, unknown or other
  misc_feature (326)..(326): n is a, c, g, or t
  modified_base (397)..(397): a, c, t, g, unknown or other
  misc_feature (397)..(397): n is a, c, g, or t
tcagtcacgtactacacgaccggtgctcgatttagagagcgtcacagagagaagggggcaggagtcagacccactcaggacacagcatggacatgagggtccccgctcagcctcctggggctcctgctgctctggctcccaggtgccagatgtgccatccagatcgacccagtcctccactccctccctgtctgcatccgtgtaggagacagacgtcaccatcacgttggccggacaagtcgaggctagttaagaatgtagttaggctggtatcagacaacgaaccgaggaacgacccgtaagcttctagacttcgtagtcggtanactacgtaccgtaaaggttaaacggtcggtacctagtacgtacgtcgacgcggataggtgctcgtggacanacgtactactacttccactacctatacacgctacgctcgacgacgtaccgtagtaagtttacgtttaacgtaacctttaacgtttacttaccttagttaacctaactaacgtaccgtaactaaacttaaccggtttaccgttaccgggtaccggggttaccggttaacccgggaaacccgggtaaaacgggtaccggttaaaacggggtaacgttaaaaccgtaaaccggtaaaccgggttaaccgttcgggtacggtccgtaacccgg

SEQ ID NO: 176738 - DNA, 687 bp, Homo sapiens
  misc_feature: GYAE6OF01CHCY7.13.48.E04.1.454.CMB.1.raw
  modified_base (541)..(541): a, c, t, g, unknown or other
  misc_feature (541)..(541): n is a, c, g, or t
  modified_base (575)..(575): a, c, t, g, unknown or other
  misc_feature (575)..(575): n is a, c, g, or t
  modified_base (619)..(619): a, c, t, g, unknown or other
  misc_feature (619)..(619): n is a, c, g, or t
tcagtcacgtactacacgaccggtgctcgatttagagagcgtcacagagagaagggggcaggagtcagacccactcaggacacagcatggacatgacgggtccccgctcagctccgtggggctcctgctgctctggcctacccaggtcgccagtatgtcgccactccagacgtcgacccagtcctacctactccctcctgtctcgctatcgtaggtaggaagacgagtacgtacctacctactccgtacgttcggaccgggtactaacggtacggaagggtacttaagttaagtaaacgttaggttaacgttttacgggtacgttacggtacgtaccgaacggtaaccggaaacggaaaaccggaaacgggaacccgtacccgtaacggtctacgttagtactacgttagtcggtactacgtaacgttaacggttaaaaggttaaaccggtcggtaccgtaagtacggtaacgttcgacggtcgtacgaggtcgtacgtcgtacgactacgtactcctactactacactacacgacgacgngaccgtcgacacgtagtacctagtatttaacgtntaacttaacttacgttgtaacttactaacgaatctacaacgttntaccgcggtacggaccgtaccggagtaaggcgtaaacggtacaacggtacgacgtagcgtaggctacg

SEQ ID NO: 176739 - DNA, 718 bp, Homo sapiens
  misc_feature: GYAE6OF01E5AUC.13.48.E04.1.454.CMB.1.raw
  modified_base (572)..(572): a, c, t, g, unknown or other
  misc_feature (572)..(572): n is a, c, g, or t
  modified_base (606)..(606): a, c, t, g, unknown or other
  misc_feature (606)..(606): n is a, c, g, or t
  modified_base (617)..(617): a, c, t, g, unknown or other
  misc_feature (617)..(617): n is a, c, g, or t
  modified_base (692)..(692): a, c, t, g, unknown or other
  misc_feature (692)..(692): n is a, c, g, or t
  modified_base (713)..(713): a, c, t, g, unknown or other
  misc_feature (713)..(713): n is a, c, g, or t
tcagtcacgtactacacgaccggtgctcgattttagagagcgtcacagagagaagggggcaggagtcagacccactcaggacacagcatggacatgacgggtccccgctcagctccgtggggctcctgctgctctggcctcccaggtgccagatgtgccatccagtactacgaccccgtagtcctaccacttccccgttcccgttgttacctcgactacttccgttaggtaacgggtaacaaccgtaggaacggtaccctaacccctacgtttaccgtaccggttcgggccccgggtaacctaaggccggtaaggggacttaaacgttaaggtaaattggtttaacggtttacgggtcgtttagggttactcgacgtacgaaacggaaaccggaacgggaaaccctacccgtacgtacgttcgttagacgttcgttacgtagtcgtaactacgtaacctttaaagggtttaaacgtccggtacctaagtacgttaacggtgaccgggtacgacgtaggtagtcctggtacgactaacgtcgtacttctacttcctactaccataccgcgacncggtacgcacgtcgacttacgtagtttacgttanacgtttacttntacgtcttactaatccgtaatactacttagttaccgcggtacgttaccggacgtaccggaaggtaccgaagtaanaaccgtacacgagttcgacgntaccg

SEQ ID NO: 176740 - DNA, 968 bp, Homo sapiens
  misc_feature: GYAE6OF01BWI8U.13.48.E04.1.454.CMB.1.raw
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
tcagtcacgtactacacgaccggtgctcgatttagagagcgtcacagagagaagggggcaggagtcagacccactcaggacacagcatggacatgagggtccccgctcagctcctgggctcctgctgctctggcctcccaggtgccagatgtcgccatccagatcgacccagtcctccactccctccctgtctcgctatcgtagtaggacgacagacgtaccaccgtactctacgttcggcccgganaacgtcgaggactattaagaactgtagttacggnttacggtatcgacgacgaacgaaccggacggaacctacccgtaagtccttacgtagtacttacgtacgtcggtacgtacctaacgttaaccgttaaacgggtttaaaaccgggtccgggtaacctaacgtaccggtaacggttacggacggtaccggtacggtacgggtacgtaccgtacggtacggtaccgtacggtaacgttaacccgtttcgttaaccgtttaccaccccgttaaccgtaacgtaccgaacgtaccccggtaacccgtccggttacggtaacccgttaccgggtaaccgttaacgggtttaaacgtttttaccgttttaccgtaaaaccccgtttttaacgtttttaacccgtttacccggttaaacggtttaaaccccgttaaaacgggtaaaccggtttaaaccccttaacgggttaaaaacccctttttacccggtttaacccggggttttaaccccggggttaaccccggggggtttaaacccgggtttaaaccccccgggggtaaaacccggggtttaaaacccggggggttaaaacccgggtttaaaacggggggttaaaacccggttaaaaaaaccccgggtttaaaccccgttttaaaaacccggggggttaacccgggttacccgggggttttaacccggggaccccccggttttaaaacccggg

SEQ ID NO: 176741 - DNA, 850 bp, Homo sapiens
  misc_feature: GYAE6OF01E48CC.13.48.E04.1.454.CMB.1.raw
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (816)..(816): a, c, t, g, unknown or other
  misc_feature (816)..(816): n is a, c, g, or t
tcagtcacgtactacacgaccggtgctcgatttagagagcgtcacagagagaagggggcaggagtcagacccactcaggacacagcagtggacatggacgggtccccgctcacgtcctccgtggggcctccgtgctcgcttcgtcggcctacccgaggtcgaccaagtagtcgtcgacctacttaccaagtacgtccgaaccctacgttcctacctacttccctccgttagtccgtagttaacgtcgtaaggtaacggacgacgtacgcgtacctaccgtacgtccgtaccggtcgggaccggaactacgggtacgaggtaactaagttaaacgacgttaaggtacgttacggccttaaggtaccaacggacgtaaaccgaaaccgaaaccgggtaaccggacctaaccctaggtctacggtactagttacgttagactacgttaaactaacggttaaacggtaaacgggtttaacgccctaaacgtacggtaacgtccgggtaacggcgtaacggtgtacggtanccggtacncgaacgtacttacctacttcaccgtactacctagacccaagggccttacgaccgtccgacgtcgaaccgtttaagtagtttaacttacgttaacccttagtttaaaccgtttccgtaacgttaaacccgtaacttaaacgttactaaaccggtttctaaaccggtttaccggttacccgggtaccgggtaaaccccgggttaacccggaaacggggttaaacccgtaaaaccgggtaaaggtaaaacgttaccccggtaaaagaacccccggttaacgggtnttaccccgggtcggtaaacccgccgtttaaccgg

SEQ ID NO: 176742 - DNA, 503 bp, Homo sapiens
  misc_feature: GYAE6OF02IOE1N.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgttgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgctaacttattactgtctacaagatacacaaattatacctgggacgtttcggcctaaagggaccaaaggtggaaatacgaaacgaactaggtaggactgacc

SEQ ID NO: 176743 - DNA, 489 bp, Homo sapiens
  misc_feature: GYAE6OF02HEIEE.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccacgatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaatgggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaattcgaaacgaactgtggctacg

SEQ ID NO: 176744 - DNA, 499 bp, Homo sapiens
  misc_feature: GYAE6OF02F6C8K.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctctgatctatggtgcatccagtttaaaaagtgggtacccatcaaggttcagcggcagtggatctggcacagacttcattctcaccatcagcagcctgcagcctgaagtattttgactaacttattactgttactacaagatcaacaattatcctgggtacgttcggacctaagggacctaaggtagaaatcaaacgaactggtaggctacg

SEQ ID NO: 176745 - DNA, 477 bp, Homo sapiens
  misc_feature: GYAE6OF02HS8HR.13.48.E04.1.454.CMB.1.raw
  modified_base (320)..(320): a, c, t, g, unknown or other
  misc_feature (320)..(320): n is a, c, g, or t
  modified_base (395)..(395): a, c, t, g, unknown or other
  misc_feature (395)..(395): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccaggtaaagcccctaagctcctgatctacgatgcatccaatttggaaacnggggtccatcaaggttcagtggaagtggatcgtggacagtattttacttcacatcagcagcctgcagcctgaagntatgacaacatattactgtcagcagtatgatatctccgatcacttcggacaaggacacgactggaatataaacgactgtcgg

SEQ ID NO: 176746 - DNA, 517 bp, Homo sapiens
  misc_feature: GYAE6OF02JP4XN.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggcattagaaatgatttaggctggtatcagcagaaaccagggaacgccctaagctctgactctatggtgcatacagtttaaaagtggtacccatcaaggttcagcgacagtggatctggcacagacttacatttcactaccatcaacgtcacgcctgacagcctagaagtatttagactaacttattactacgttctaacgtaagtactacaacgtaattactaccgtggtaccgttcggactaacggaacctaggtagaactacgaacgtaactgtacgactacg

SEQ ID NO: 176747 - DNA, 515 bp, Homo sapiens
  misc_feature: GYAE6OF02HPE7W.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgattaggctggtatcagcagaaccagggaaagccctaagctcttgatctatggtgcatccaagtttaaaaagtgggtacccatacaaggttcagcgcagtgatcgtggcacagacttcattctcaccatcagcacgcctgcagcctagaacgtattttgactaacttattactgtactacaagatacaactaattactcgtagggtacgttcggaccgtaacgggacctaaagggtagaaactacgaaaacgtaactaggtaggctacgg

SEQ ID NO: 176748 - DNA, 574 bp, Homo sapiens
  misc_feature: GYAE6OF02JS7FU.13.48.E04.1.454.CMB.1.raw
  modified_base (226)..(226): a, c, t, g, unknown or other
  misc_feature (226)..(226): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaaatgatttaggctggtatcagcagaaaccagggaaagccccgtaagctcttgatctatggtgcatccaagtttaaaagtgggtcccatcaaggttcagcggcagtgatctggcanagacttcattcncaccatcagcagcctgcagcctagaatatttagacttaacgtttacttactagttctaactaaacgtattaccgaactaatttacgtacccgttagggtaaccggtttccgggtaaccgtaaacggggtaacccgtaaaggggttaaccggaaaacttaaccggtaaaaccggtaaccggttacggtacgggtaccgttaaccgg

SEQ ID NO: 176749 - DNA, 544 bp, Homo sapiens
  misc_feature: GYAE6OF02JBIJR.13.48.E04.1.454.CMB.1.raw
  modified_base (226)..(226): a, c, t, g, unknown or other
  misc_feature (226)..(226): n is a, c, g, or t
  modified_base (386)..(386): a, c, t, g, unknown or other
  misc_feature (386)..(386): n is a, c, g, or t
tcagtcacgtactacacgaccggtgctcgatttagagagcgtcacagagagaagggggcaggagtcagacccactcaggacacaacatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggcattagaaatgatttaggctggtatcagcagaaaccagggaaacgcccctaagctcttgatctatggtgcatacctaagtttaaaaaggtcggggtacccatacgtaaggttcaggcggcgagtggatcgtggcacagtacttcactttccncaacctatcagcagcctgcagcctagaagtattttcgacttaactttattactgtactaacaagtatacaactaattacgtccgtagggtaccgttccggaaccgaacgggtacctaagggtacgaaataccgaacggtactaggtacggtactgacc

SEQ ID NO: 176750 - DNA, 523 bp, Homo sapiens
  misc_feature: GYAE6OF02IYSV1.13.48.E04.1.454.CMB.1.raw
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaaccagggaaagcccctaagctctgatctatgtncatctaagtttaaaagtgggtacccagtcaaggttcagcggcagtggatcgtggcacagacttctattcncacatcagcacgcctgcagcctagaagtatttgactaactttattactgttactanaagtatacaactaattacgtcctagggtaccgttcggaccgaacgggaaccgtaaggtacggaaactcgtaaaacggactaggtacgtacgtacg

SEQ ID NO: 176751 - DNA, 789 bp, Homo sapiens
  misc_feature: GYAE6OF02JI3VZ.13.48.E04.1.454.CMB.1.raw
  modified_base (279)..(279): a, c, t, g, unknown or other
  misc_feature (279)..(279): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctccaggtgccagatgtgccatccagatgacccagtctccatcctccctgtctgcatctgtagagacagagtcaccatcacttgccaggcgagtcaggacattaacaacttattaaatggtatacagcaagaaaccaggtaaacncccctaaagcctacctagatactacgatgactatacctaaagtttacggaaaactacggggttaccccaagttaccgtaaacggtttacgaaggttaacggtaaaggttacgggtaaagtttcccggttaagggggaaaccttaagggtttaaactttttttaacccgttttaccgaaaccccgttaattaaccgtaacggacctaacggtcccttaggacccgttaacgacccggttaggaaaacggtatttaaacgtttacggaaccctaaaacttaagtttaaaccgtttaaacgttcggtaacgtaaacgtaccgttaaacgtttaagttaagttaaacttaaaccgttacccgttaccccgttaacgttacccgttaaaccccgtttcccggggtaaaaccgaaaccgggggtaaccctaaaccgggttaacccgttaacggggggtaaacctaaaccggtttttaaaaaccggaacccggttttcggttaaccggggtaacccg

SEQ ID NO: 176752 - DNA, 533 bp, Homo sapiens
  misc_feature: GYAE6OF02HQA1D.13.48.E04.1.454.CMB.1.raw
  modified_base (440)..(440): a, c, t, g, unknown or other
  misc_feature (440)..(440): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaacgccctaagctcttgatctatggtgcatccaagttttaaaaacggtgggtaccctatacaaggttcagcggcagtggatcgtggcacgagacttcatttctacacctatacacgcaacgcctgcacgccgtagaacgtattttacgctaaactttattactntactaacaagtactacaactaattctaccgtacgggtacgttcggaccgaagggaccgaaggtacggaatcgaaaccgtacgtggtcgatacg

SEQ ID NO: 176753 - DNA, 693 bp, Homo sapiens
  misc_feature: GYAE6OF02IW6QI.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggcagtcaggacattaacagttattagtctgtatcagacaaaaaccgaggaactccctaagctcctagatactatgttcgctactcctatttgactaaaggtcggtacccatcaaggttacaggcggactaggtggatcggtagggaacagtaacttccaacgtcctacgaactaaactcgaagaccgtagtccctaggaccgaacgtccgttaagtaaacgttactttttacggaacctttaaaccgtttaacgtttaacctttacggtaaacctaaaccgttaacgttaacccttttaaacgttaacccggtttaaccccgttacgtttacccggttaacgggttttacccgggggaaccggggtaaccggggttaacccggaaaagggggtttaccggggaacgttaaacgtaaccccgggtaaaacgtaaccggtttacgggtacgggttaccgtacggtaaccccg

SEQ ID NO: 176754 - DNA, 496 bp, Homo sapiens
  misc_feature: GYAE6OF02FY7YH.13.48.E04.1.454.CMB.1.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcacgacattaacacttatttagcctggtatcagcagaagccagggagaggtccctaaattacttgatctctgctgcgtccgccttgcaatcgggggtcccatctcggttcagtggcggtggatcgtaggacagattcactctcgacatcaccacctgcacctnaagntgttaggattattactgtcagactatagtgtgcccgntcatttcgcggacggactaagggtcncgaagatacgaaacgacgtgtacggcgtgctaaccg

SEQ ID NO: 176755 - DNA, 572 bp, Homo sapiens
  misc_feature: GYAE6OF02IM4AH.13.48.E04.1.454.CMB.1.raw
  modified_base (225)..(225): a, c, t, g, unknown or other
  misc_feature (225)..(225): n is a, c, g, or t
  modified_base (305)..(305): a, c, t, g, unknown or other
  misc_feature (305)..(305): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggnaagtcaggcattagaatgatttaggctggtatcgagacaagaaaccgagggaaacgcccctaagctctgatctagtggtnactatacctaagttaaacggtcggtaccatactaaggtcagcgactagtgatcgtgacacagtacttctattccacactatcagcacgcctagacctacgtcctaagtaacgttatttacgaaccttaactttactttacgttagtaacctaacgaacgttactactaaacgttactttacgtccggttacgggtaccgtaccgggaaccgaaacgggtaaccgaagggttaagtaacgtacgaaacgtacgtggtacgtactaccg

SEQ ID NO: 176756 - DNA, 599 bp, Homo sapiens
  misc_feature: GYAE6OF02GS5CQ.13.48.E04.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtagganacagagtcaccatcacttggccgggcaagtcagggcattaagaatgtatttaggctggtatcagcaagaaaccgagggaaacgcccctaagctctgatctatggtncatacctaagtttaaaagtgggtaccagtacaaggttcagcggctaggtgactcgtggcacagacttctacttctacaccatcacgacacgcctagcgactcgtagtaacgtattttcggactttaaactttatttacctacgtttacctaactaacgtaatacctaaacttaacgtttctaccggttgggtaacccgtttaccgggaccgtaaacggggtaaccgtaaagggttaacggtaaaacgttaacccggaaaacggtaacgtttacgggtaggtaccgtaacgg

SEQ ID NO: 176757 - DNA, 550 bp, Homo sapiens
  misc_feature: GYAE6OF02F3TWI.13.48.E04.1.454.CMB.1.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccttcctgtctgcatctgtaggagacagagtcaccatcacttgccgggccagtcaggacattaacagttattagtctggtatcagcaaaaaccngggaaagtccctaagctcctgatctatgttgcatcctatttgactaaagtcgggtacccagtcaaggttcagcggnagtgatcgtggactagacttcactctacacatcagcagcctgcagcctgaaatntttacgacttaacttacttactgtaccaaactagttactttaaatacggtttacccgacttacgtacggtttacggacgggtaacgggtaacccgtaagggtggaacgtaacgtaccgaaaacgtacgttcggaggtacgttcgacccg

SEQ ID NO: 176758 - DNA, 614 bp, Homo sapiens
  misc_feature: GYAE6OF02HDHG1.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttggccgggcaagtcagggcattagaatgatttaggctggtatcagcagaaacagggaacgcccctaagctctgatctatggtgcataccgtaagtttaaaaggtcgggtacccaagtcaacgggttcaaggcggcgagtggtatcgtggcacgacgtacttacactttctacaccatccagacgacgcctgccacgtcccgttaggaacgttagtttttacgaaccgttaacttttaacgttacttacggttaccttaaacgaagtaacttacctaaacttaactttacgtaccggttacgggtacggtttcccgggaaccgtaaacggggtaaccgtaagggttaacggtaaacgtaccgtaaaaccggtaaccgtagggtacggtacttaccgg

SEQ ID NO: 176759 - DNA, 550 bp, Homo sapiens
  misc_feature: GYAE6OF02FM5JZ.13.48.E04.1.454.CMB.1.raw
tcagtcacgtactacacgaccggtgctcgatttagagagcgtcacagagagaaggggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaatgatttaggctggtatcagcagaaaccagggaaagcccctaagctcttgatctatggtgcatacctaagtttaaaaaggtcggggttacccagtctaaaggttcaggtcggcaggtggatcgtggacacgacgactttcactttcacacccatccagcagcctgcagccgtgaaagtacttttgacttaacttattactgtactaacaagtactacaactaattactaccgtagggtacgttccggaccaaacgggtaccgtaaagggtacgaaagtaccgaaaacgtacgtaggtacggctaacg

SEQ ID NO: 176760 - DNA, 521 bp, Homo sapiens
  misc_feature: GYAE6OF02HB6Q2.13.48.E04.1.454.CMB.1.raw
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaatgattaggctggtatcagcaagaaaccagggaaacgcccctaagctcttgatctatggtgctataccaagtttaaaagtcgggtaccagtcgaagttcgagtcgacgagtggatcgtaggcacagtacttnattcncacatcagcagctgcagcctagatatttgactaactttatactgtactaacaagtactacaactaattactccgtaggtacgttcggaccgaacgggtaccgaaacggtagaaacgtacaaacgtacgtagcggtactacgg

SEQ ID NO: 176761 - DNA, 551 bp, Homo sapiens
  misc_feature: GYAE6OF02HYT7Z.13.48.E04.1.454.CMB.1.raw
  modified_base (304)..(304): a, c, t, g, unknown or other
  misc_feature (304)..(304): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaatgattaggctggtatcagcaagaaccagggaaacaccccgtaagctcttagatctatggtncatcctaagtttaaaacggtgggtccctatacgtaagttcgagcggcgagtgtatcgtggacactagacttacagtttcctacaccatcagcacgcctgctagcctagtaacgtattttcgactaacttattacgtcgtactaactaagtactactaactaattctccgttagggtaccgttcggaaccgtaacgggaaccgtaaggtagtaactaaccgaacgtaacgtcggtaggtactaaccgg

SEQ ID NO: 176762 - DNA, 757 bp, Homo sapiens
  misc_feature: GYAE6OF02JCAVG.13.48.E04.1.454.CMB.1.raw
  modified_base (226)..(226): a, c, t, g, unknown or other
  misc_feature (226)..(226): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaaatgatttaggctggtatcagcagaaaccaggtaaacgcccctaagcctcctgactctacgatgctataccaagtttaggaaaacgtacgggggtaccccaagtccgaaaggtttcgaggttagggtaaaggtggtaagtccgttagggggtaacctaaggttaactttttttaacccgtttaccgaaacccttaattacccgaaacggtccaacgggtcccgttacgggaccctaacgggtcccctttaagggaaacgtaacgtttaacgtttacggaaccctaaaaccgttaatttaaacgttttaaccgttacggttaaccctaagggtacccgttaaaggtttaaacttacgggttaaaattaaaccgtttccccgttaaccccggttaatttaccccggtaaaccccggttttaccgggaaccccgtaaaccgggggaaccctaaacccgggtacgttaacggggaaacgttaaaaccgtttaaaccgggtaaccgtttaggttaccggg

SEQ ID NO: 176763 - DNA, 625 bp, Homo sapiens
  misc_feature: GYAE6OF02IEJT5.13.48.E04.1.454.CMB.1.raw
  modified_base (203)..(203): a, c, t, g, unknown or other
  misc_feature (203)..(203): n is a, c, g, or t
  modified_base (480)..(480): a, c, t, g, unknown or other
  misc_feature (480)..(480): n is a, c, g, or t
tcagtcacgtactacacgaccggtgctcgatttagagagcgtcacagagagaagggggcaggagtcagacccactcaggacacagcatggacatgagggtccccgctcagctccgtggggctcctgctgctctggctcccaggtgccagatgtgccatccagatcgacccagtcctccatcctccctgtctgcatctgtaganacagacgtcacatctacgttggtcgggacaagtcgagggctagttaagaatgtagttaggcgttaggtatcgagacaacgaaaccgaaggaacgacccctaagccttacgttagatactagtggtctacactaccgtaaaggtttaaaaggtcgggtaccctagtacgtaaggttcaggcggtacgtagtagtactcgtaggacacgtacgtacttctacgtttcctaccaacctatacacgtacacgtcctcgacgacgtaccgtagaaacgtttnttacgtacttaacgttacttaccgtgttaactaacgtagtactactaaacttaacttactccggttaacggtaccggtaccggaacccggtaaggtaacctaagggtaacgtaactaacgaaaccgttacgtggtacgtataccg

SEQ ID NO: 176764 - DNA, 809 bp, Homo sapiens
  misc_feature: GYAE6OF02HA6HK.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtctccatcctcctgtctgcatctgtaggagacagagtcaccatcctacttcggccgggcaagtcgaggggcaattacgaaatgtaatttaggcgtggtatcgagacaaggaaaaccgagggaaaccgtaccccgtaaggctaccgttgacttacttagtggttgactacttaccgtaaaggttttaaaaaacggtcgggggttaccctaagttacgtaaacggggtttaccaacggtacgggacgtaagggtcgggtaacttccggttacggggacctaaccggtaacggtaaccctttaccgtaaacttttccgtaaccctaacccggttaaattacccgaacggtaccgtaaccgggttacccttacgggacccgtaaccggttccccgtaagggttaaaacgtttacggttttttaaccggaacctttaaaaccgttttaacgtttaacccgtttaggtttaacccttaaacgtaaaacgtaacttaaccctaaactttaaaccttttacgttaccccgttagggggttaacccggttttcccggggaaccggaaacggggtaacccgtaaagggtaacgggtaaaacttacccgggaaaaacgttaacggttagggttaccggtattaacccgg

SEQ ID NO: 176765 - DNA, 504 bp, Homo sapiens
  misc_feature: GYAE6OF02FGIWS.13.48.E04.1.454.CMB.1.raw
  modified_base (226)..(226): a, c, t, g, unknown or other
  misc_feature (226)..(226): n is a, c, g, or t
  modified_base (369)..(369): a, c, t, g, unknown or other
  misc_feature (369)..(369): n is a, c, g, or t
  modified_base (423)..(423): a, c, t, g, unknown or other
  misc_feature (423)..(423): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggcattagaaatgatttaggctggtatcagcagaaccagggaaagccctaagctctgatctatggtgcataccaagtttaaaaagtgggtacctatacaaggttcagcggcagtgatctggcacagtacttcattcncaccatcagcagcctagcacgccgaagtattttgactaacttatactgtactanaatatcactaattataccgtggacgttcggaccgtaagggaccgtaaggtagaaatacgaaacgacgtgtaggtctagacc

SEQ ID NO: 176766 - DNA, 599 bp, Homo sapiens
  misc_feature: GYAE6OF02G69QI.13.48.E04.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtagganacagagtcaccatcacttgccggnaagtcaggcattagaatgatttaggctggtatcagacaagaaaccagggaaacgcccctaagctacttagatctaatggtgcataccgtaaagtttaaaaggtcgggtacccaatacgaaggttacaggacgcgtaaggttggattcgtggacacgtacgtacttcgtaattctacaacctatcgacgtcaagccctagcacgtcctagtaagttattttcgaacttaacgtttattactcgttactaacgaagtacttacaagtaacttacgttaccgtcggggtaaccgttacggtaccggaaacggtaaccgtaaacgggttaggtaaaacctaccgtaaaaccggtaaacgtcggtacgggtcctaacgg

SEQ ID NO: 176767 - DNA, 581 bp, Homo sapiens
  misc_feature: GYAE6OF02FU8CG.13.48.E04.1.454.CMB.1.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaaatgatttaggctggtatcagcaagaaaccagggaaancccctaagctcttgatntatggtgcatctaagtttaaaagtcgggtaccatacaaggttcaggcggcagtgatcgngcanagacttanattctcacctancacgacacgccttgccaggtaccgtagtaaagtactttttacggacttaaacttattacgttagttacctaacgtaaacgtactacctaactaaagttaccttaccggtacggtaccggtttaccgggaaccgtaaacggggtaacccggaagggttaaggaaactacgtaaaaccgtacgtacgggtacggtcgtaccgg

SEQ ID NO: 176768 - DNA, 699 bp, Homo sapiens
  misc_feature: GYAE6OF02F92HP.13.48.E04.1.454.CMB.1.raw
  modified_base (201)..(201): a, c, t, g, unknown or other
  misc_feature (201)..(201): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtagganacagagtcaccatcacttggccgggacaagtcgagggcattagaaatgatttaggctggtatcagcaagaaaccgagggaacgaccctaagctctgatctatggtgcattaccgtaaaggtttaaaacggtcggggtaccctaagtacgtaaacgggttcaacggtcggtacgtaagggttagggtacgttcggttacgggaaccaaccgtaacgttacctttacgtaacttttaccgttacccaaccctaacgtaccgtaacggaccgtaaccggccccgttagacccgtacggtacccgttaaggtaaacggttacgtttttacgaacctttaaacttttaagttaccgttacgttacctaaacgtaacgtaactaacctaacgttaaatttacgtacccggttaggggtacccgttccgggaaccgtaaccggggtaaaccgtaagggttaagtaaaccgtacgaaaaccggtacgtcggttacggtaccgtacg

SEQ ID NO: 176769 - DNA, 584 bp, Homo sapiens
  misc_feature: GYAE6OF02I7UE8.13.48.E04.1.454.CMB.1.raw
  modified_base (201)..(201): a, c, t, g, unknown or other
  misc_feature (201)..(201): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtagganacagacgtccaccatcacttcggaccggcaagtcgagggcattagaaatgtatttaggctggtatcagacaagaaaccgagggaaacgcccctaagccttctagactctagtggtgacactaccgtaagtttaaaacggtcgggtacccaatacgaaggttcagtcggntaggtgatcgtggcacgagtactctattcncacatacagcagtcagcacgcctagtaacgttatttacgacttaactttacgttaccgtagtaacctacgtaaacgtactactaacctaatttctaccgttaggtaccggttacggaccgttaaacgggacctaacgggtacgtaaactacgtaaaccgtaacgtacggtacgtaccgtaaccg

SEQ ID NO: 176770 - DNA, 627 bp, Homo sapiens
  misc_feature: GYAE6OF02F8GDE.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggcagtcaggcattagaatgtatttaggctggtatcagacaagaaaccgaggggaacgccctaagctctgatctagtggtgctatacctaaggttaaaacggtcgggtacccagtacgaaggttcacggcggacgtaggtggatcgtacggcaacgagtacttactattcctaccacctatcacgacacgtcctagacacgtcctaggtaacgttattttacgaaccttaactttacgtttacgttcgttacctaacgtaagtaacttactaacttaacgtttacgttaccggttacgggttaccggttaccgggtaaccggtaaacggggtaacccgttaaagggtaaccggtaaacgttaaccgtaaaaccggtaacggttacgggttacggtacgtaaccgg

SEQ ID NO: 176771 - DNA, 661 bp, Homo sapiens
  misc_feature: GYAE6OF02IFBE2.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagacgtcaccatcacttggccgggcaagtcgagggcattaagaaatgtatttaggcttggtatcagcaagaaacccaagggaaacgcccctaagcctcttgatctatggtgcatacctaagtttaaaaggtcgggtacccaagttacaaggttcaggtcggactaggtaggacttcgtacggacaacgtagtacctttctactttcctaccgaacctataccaacgaccgtacgcccgttgacctacggtacccgttagaaacgtttattttacggaaccttaaacgttttacgtttaccgttacgttaccttaacgtaaacgtacttactaaaccttaatttaccgttcccggttagggtacccggtttaccgaacccggtaaacggggaacccgttaagggtaacggtaaacgtaacccgtaaaaccggtaacgttacgggtacgtacgtaaccgg

SEQ ID NO: 176772 - DNA, 605 bp, Homo sapiens
  misc_feature: GYAE6OF02FSIUZ.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgcccatccagttgacccagtcctccatcccttcctgtctgcattctgtaggagacagagtccaccatcacttggccgggccagtcaggacattaacagttattagtctggtatcagacaaaaaccgagggaaactccctaagcctacctgatctatgttgctatccctatttgactaaggtcgggtaccctatccgtaaggttcaggcggctaggtgatcgtgggaacaggtaacttcactctacacaaactcaacgtcacgcctcggactacgcctagaacttatttcgactaaactttacttacgacgttacaaacttaggtactttaaagtacccggttaccctctacgttacggtttaccgggacgggtaaccgggaacgtaaacgggttcgggaagtaacgttaacccgtaaaagggtaccgttcggtaggacccgttagccctaacg

SEQ ID NO: 176773 - DNA, 565 bp, Homo sapiens
  misc_feature: GYAE6OF02FU85D.13.48.E04.1.454.CMB.1.raw
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagacgtcaccatcacttgccgggcagtcaggacattaacagttatttagtctggtatcagacaaaaaccgagggaaacgtccctaagctacctgactcttatgttgctactcctactttgacgtaaaggtcgggtaccagtacgaaggttcagcggcaggtgatcgtgcanagtacttcattccncaccatcaagcagcccgtgacctacgaccttaggaacgttatttttcgaccttaactttattacgttgtactaacgaagtactactaactaatttacgtccgtagggtaccgttcgggaccgtaaacgggtacccgaaggtacgtaataccgaaaccgtagtggtacggtactacgg

SEQ ID NO: 176774 - DNA, 522 bp, Homo sapiens
  misc_feature: GYAE6OF02H3MJ8.13.48.E04.1.454.CMB.1.raw
  modified_base (304)..(304): a, c, t, g, unknown or other
  misc_feature (304)..(304): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaaatgatttaggctggtatcagcaagaaaccgaggaaacgccctaagctcttagatctatggtncatacctaagtttaaaagtcgggtacccatacaaggtcagcggacagtgatcgtggacacgagtacttcattctacaccatcagcacgtcctagcagtcctagtaagtatttacgacttaacttattactgtactaacaagtactacaactaattactccgtacggtacgtcggaccgaagggtaccaaggtagaatacgaaacgacgtgtagctacg

SEQ ID NO: 176775 - DNA, 513 bp, Homo sapiens
  misc_feature: GYAE6OF02HK7BZ.13.48.E04.1.454.CMB.1.raw
  modified_base (377)..(377): a, c, t, g, unknown or other
  misc_feature (377)..(377): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgattaggctggtatcagcagaaaccgaggaacgccctaagctcttagatactatggtgcactaccgtaagtttaaaaggtcgggtacccatacgaaggttcaggcggcagtggatcgtggacacgagtactntacttctcacactcagtcagcctgcacgctagagtatttgactaacttattactntactanagtatacataattctcgtaggtacgtcggacctagggaacaggtagaactcgaaacgtagtacggtgtacgtacg

SEQ ID NO: 176776 - DNA, 641 bp, Homo sapiens
  misc_feature: GYAE6OF02GB7CI.13.48.E04.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatcgacccagtctccatccctccctgtctgcatctgtagganacagatcaccatcacttggccggnaagtcgagggcatagaaatgtaatttaggctggtatcagtcgaacgaaacgagggaaacgcccgtaagctctagatactagtgtgcatacctaagttaaaacggtcggtaccatacgtaaggttacaggcggagtaggtaggtatcgtaggaccatacggtactttaccgtatttcctacctaaccgattccgagaccgtacgccttacggaccgacgtcccgttaaggtaacgtttaacgttttcggaaccttaaacgtttaactttacgttacgttaactaaccgtaaattaccgtacaaactttaattacgttaccgtagggttacccggttcggaaccggaacggggtaaccgtaaagggttacggaaaacgtaccgtaaaaccggtacgttacggtacggtacctacgg

SEQ ID NO: 176777 - DNA, 773 bp, Homo sapiens
  misc_feature: GYAE6OF02JIZTI.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtcgccatccagatcgacccagtcctccatcctccctgtctgcattcgtggtaggagacaggtacgtccaacctatcctaccgttgggacccggggactaaacggtcgacggggtacctaagttaacgtaaagtaggtaacgttttaaggtccgttaggttacgttaccgacggtactaaaccggaaaacccggaaacggggtaaaccgtaacccccgtaacgtaccgttacgttacggtaacttacgttaagttcgggttacgacctaacgttaaccgttaaaagggttttaaaacggtcgggtaccctaagtaccgtaacggtacgtacggcggtacgtaggtaggtacgttcgtacggtacctacgtaacgtacccttactaaccttccgtaccctaacgtacttacgacggtactacccgacgttaccggaccgtaaccgtaccgttaaggtaacgttacgttttacgaccgttaacgtttacttacgttacgtactaacgtataactactaaacttaacgttaccgttacgtacgggtacccggtttaacggaacccggtaaacgggaccgtaagggtaaccgaaacgtaacggtaaacgcgttacggacgtctaacg

SEQ ID NO: 176778 - DNA, 560 bp, Homo sapiens
  misc_feature: GYAE6OF02GNK2O.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtcaccatcacttgccgggcaagtcagggcattagaaatgtatttaggctggtatcagcaagaaaccagggaaacgacccctaaggctcttgatctagtggtgacattaccgtaagttaaaacggtcgggtaccctagtactaaggttcaagcggcagtggtatcgtgacacgagtacttcgtattcctacaccatcacgcacgcctgtcacgtctagagttatttcgactaacttattactgtactacgaatactacaactaattacgtaccgtcgggtaccggtcggaaccgtaacgggtaaccgtaagggtagtaaacgtacgaaaccggtagtaggtcggtactaccgg

SEQ ID NO: 176779 - DNA, 711 bp, Homo sapiens
  misc_feature: GYAE6OF02JN32B.13.48.E04.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtagganacagacgtcacctatcacgttggccgganaaggtcgaggcagttaagaatgtaagtttaggctggtatcgagacaacgaaaccgaggaacgtacccctaagccttacgtagactcgtaagtcggtagtactacttaaccgtaaaggtttaaaacggtcgggttaccctaagttaacggtaacggttacgtaacggaccggtacgtaaggtcgtaacgttacgtacggtaaccaacgtaacgtacctttacgtaactttccgtacctaaccgtaactcgtacgacgtaccgtacgttcgacgtacgttacccttaaggaacttacgttttacgaacttaacgtttacgtttaccgttacttaaccgttaacgtaaacgtaacttacgtaaacttaacgtttaccttacggttaccgggtaaccggttccggtaaaccggtaacgggtaacccgtaaagggttaacgtaaacgtaaccggaaaccgtacggttacggtacgtacgtaccgg

SEQ ID NO: 176780 - DNA, 664 bp, Homo sapiens
  misc_feature: GYAE6OF02IAG6D.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtcaccatcacttcggccgggacaagtcgagggctaattaagaaatgtaagtttaggcttggtatcagacaagaaaccgagggaaacgcccctaagccgttacttgacttctagtggtgactagtaccgtaaaggtttaaaacggtcggtaccctagttacgaaggttacacggcgacgaggtagacttcgtcggacacgtagtacttactactttaccgtaccactaacttcaacggacctacgtcccgtagacgtaacgtcctaaggtaactttagttttcgaacttaaaccgttttacttacgttaactacgttaacaaagtactaaccgaaacttaacgttactacccgggttacgggtaaccgttccgggaaccggtaaacggggtaacccgtaaagggttacgtaaacgtaaccggtaaaaccgttaacggttggttaccggacttacccg

SEQ ID NO: 176781 - DNA, 659 bp, Homo sapiens
  misc_feature: GYAE6OF02GBGRK.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtccacatcacgttggacccggggacaaacggtcgaggggcaagttaagaaattgatttaggctggtatcagcaagaaaccagggaaacgcccctaagctcttgatctatggtgctatacctaaagtttaaaacggtcgggtaaccctagtacgtaacggttcacggcggacgaaggttggaactcggtaggaccacacgtacttactactttaccctacaacccgtaactcgaacgactaacgccttaggaccacggtaccctacggtaaagttctttttacgacccttaaaacttttacgttaaccttcggttaacctaacgaaacttaactactaaacttaactttactaccgggttacgggtaacccggtttccgggaacccgtaaacgggtaacccgtaagggtacgtaaacgtaccgaaaacgtacgttaggttacggacttaccgg

SEQ ID NO: 176782 - DNA, 598 bp, Homo sapiens
  misc_feature: GYAE6OF02FKGB5.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcagttggctaactcttttaaattggtatcagcagaagtcgagggcaacgccccgaacctcctgactctacggtacactcctactttcgcacaggtcgggatcccatcgaaggttcaggtgcagtagatcgtaggaactagtactttaccctactaacctagtacgaggggtacctacgacgtaccgtagtaacgtattttcgaccgttaactttacttattacgtaacctaacgtacgtactttaacccgttcccgtacccccgggtacgttccggacccgtaagggaacccgtaggtacggtaacgtacgtaacggtacgaacgttacgtggacgtcgaccgtaccactttacgtcgttacc

SEQ ID NO: 176783 - DNA, 588 bp, Homo sapiens
  misc_feature: GYAE6OF02FWN1F.13.48.E04.1.454.CMB.1.raw
  modified_base (425)..(425): a, c, t, g, unknown or other
  misc_feature (425)..(425): n is a, c, g, or t
  modified_base (488)..(488): a, c, t, g, unknown or other
  misc_feature (488)..(488): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttcggccggcaagtcgaggcattagaaatgtatttaggcttaggtatcgagacaacggaaaccgaagggaaacgaccccgtaagctacttagatctagtggtgactattaccgtaaaggtttaaaacggtcgggtaccagtacgtaacggttcacggcggacgaggtggtacttacgtggaccacgtacgtcctttactactttaccnctaccataccgacgacacgcctgcgacgtcgtagagttagtttcgacttaacttattacgttntacgtaacaatatactacttatacttcgtacggtacgttcggaaccgtaagggtaccgtaaggtaacgaacgtacaaaccgtacgtcggtacggactacg

SEQ ID NO: 176784 - DNA, 741 bp, Homo sapiens
  misc_feature: GYAE6OF02IGQUO.13.48.E04.1.454.CMB.1.raw
  modified_base (465)..(465): a, c, t, g, unknown or other
  misc_feature (465)..(465): n is a, c, g, or t
  modified_base (532)..(532): a, c, t, g, unknown or other
  misc_feature (532)..(532): n is a, c, g, or t
tcagtcacgtactacacgaccggtgctcgatttagagagcgtcacagagagaagggacaggagtcagacccactcaggacacagcatggacatgagggtccccgctcagctccgtggggctcctgctgcttctggctcccgaggtcgcctagatgtgccatccagactgacccagtctcactcctccctgttctagacctattcgtaggtaggagaccgtaagcgtaccaacctacgtacctaacgttcgggaccggacgtaaccggtacgacgggccttaaagttaacgaaaagttgtaaacgttttaccggagttacggtacttcgaacgtacgaaacggtaaacccgaaggggtaaccctaacccgtaagtccttacgtacgtactacgtaacgtggtacgtactaacgtaccgtaaaggtttaaacggccggttaccaatacgtaaggttcacgtacggtntacgaggtatccggtgacgtacaacggtacttcgtaacgttccgtaaccacgtactacgacggtacncgttcctggaaaccctcgtaccgtaggtaaactttcgttaccgtaaccgtaactttacgtaacgttcgaaaccttaagaacgttacacgttaaaccgttagtaccgttcccgggttagggtacccgtaaccggtcgttaaaccgggaacctttaaaggggactttaaacgtaccggaaaaccgttcggtaacggtgtaacccggtaccg

SEQ ID NO: 176785 - DNA, 719 bp, Homo sapiens
  misc_feature: GYAE6OF02FH8B7.13.48.E04.1.454.CMB.1.raw
  modified_base (598)..(598): a, c, t, g, unknown or other
  misc_feature (598)..(598): n is a, c, g, or t
  modified_base (616)..(616): a, c, t, g, unknown or other
  misc_feature (616)..(616): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctccaggtgccagatgtgccatccagatcggacccagtcctaccactccctccctgcgtcgcactcgtagtacggacgtacacggtactcccaacctcgtacctaacgttccgacccggtaggaccgtacggactaacggacctaacttaaccgtaacgtactttttaaacggtggttacctacgaacgtccgtaaacaaacccggtaaacggtaaacccgtacccgtaacgtccgttaccggtactataccgtaacgtactacggtaacctacctaccgtttaaaagttaccggggaaaaccgtcccggggtaacccttagtaaaccggttaacggttacgaacggttaaggggtacgaccgggttacttacggggaacgggtactttaacctttactttacccctaaactccgtaactcgaccgacgtccaccgtcgacttcgactaaggatacttgaaccnctaatacgttaactacgngtaccgtatacgtaattgaaactacgtactccgacctcgtaacctcccggtaagccgtaacgacgtaccgagttacggtactaaacgtacgcttggtcctacg

SEQ ID NO: 176786 - DNA, 770 bp, Homo sapiens
  misc_feature: GYAE6OF02IPIS9.13.48.E04.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
tcagtcacgtactacacgaccggtgctcgatttagagagcgtcacagagagaaggggcaggagtcagacccactcaggacacagcatggacatgagggtccccgctcagctcctggggctcctgctgctctggctcccaggtgccagtatgtgcctatccagatgacccagtctccatcctcctgtctgacatctgtagganacagcgtcactntcatcgcgganagtcaggcattagaatgtattaggctaggtattacgagcgaacgaaacgaacgggaaaacgtccccgtaaaggccttacgttacggtaacttaccgttaagtcggttacgcctaaccgttaccgttaaacggttttaaaaaacggtccgggtacccctaacgttaccgtaaagggttacctaacggtacggacgtacggtaagtacgtaccggttaggtaccgaacacggtaacgttttcctaactttaccctaccctaaccgaattcccgaaagttccgaacgtacccgttcgaccgtaacggtacccgttaacggtaaacgttttacgttttacggaaacctttaaaccgtttaacgtttacttaccggttaaccttaacgtaaacggttaccttaactaaaccgttaacttttaaccgtacccggtttagggttaacccggtttaccggaaccgggtaaaccggtttaaacggaaacggtttaacgggtaaactacccggtaaaaaccggttaacgtaacggtttacggaccgttaacccgg

SEQ ID NO: 176787 - DNA, 666 bp, Homo sapiens
  misc_feature: GYAE6OF02F79SS.13.48.E04.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatacagatgacccagtcctccatccctccctgtctgcatctgtagganacagatcaccatcacttgccgggcaagtcgagggctattaagaaatgtatttaggcgtggtatcgagcaagaaaccgaggaaacnccctaagctcgtnatctatggtgactactactaagtttaaaagtcgggtaccatacgagttcagcgactgtagatcgtggacacgagtaccttacgactttcgaccaacctatacgaacgtcaccggtacccgttaggacctacgacccgttaaggtaagttaacgtttttaccggaacttaaccgttttaaatttaccgttagtttacctaaacgtaaacgtaacgttacaaaactttaacgttaaaccgttccgtaacggggttaacccgttcggggtaaacccgtaaacgggggtaaacccggtaaggggttaaacccggtaaagttaaacccgttaaaaccggaacgttacgggttaccggtaccgtaacccgg

SEQ ID NO: 176788 - DNA, 700 bp, Homo sapiens
  misc_feature: GYAE6OF02ICF0Z.13.48.E04.1.454.CMB.1.raw
  modified_base (251)..(251): a, c, t, g, unknown or other
  misc_feature (251)..(251): n is a, c, g, or t
  modified_base (522)..(522): a, c, t, g, unknown or other
  misc_feature (522)..(522): n is a, c, g, or t
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
  modified_base (603)..(603): a, c, t, g, unknown or other
  misc_feature (603)..(603): n is a, c, g, or t
  modified_base (686)..(686): a, c, t, g, unknown or other
  misc_feature (686)..(686): n is a, c, g, or t
  modified_base (693)..(693): a, c, t, g, unknown or other
  misc_feature (693)..(693): n is a, c, g, or t
tcagtcacgtactacacgaccggtgctcgatttagagagcgtcacagagagaagggggcaggagtcagacccactcaggacacagcatggacatggacgggtccccgctcagctccgtggggctcctgctgctctggcctcccgaggtcgccaggatggtcgccatccgagatcgaccctagtccacctactccgtcctgtctcgcattcgtgtaggagacagacgtcaaccatccgtacgtcggccgganaacgtcgaggtacaagttaagaatgtagttacggcgtaggtatcgaagaccgaaacggaaaccgaacggggaaacctaccccgtaaggtccttggttaacgtacgtaacgttggttacggcgtaaccttaacgttaaccggttaaaaagggtttaaaacggtccgggtaccttaacgtaacggtaacggttccgaacgggaccggtatacgggtacggtaacgtttacgcggactaacggtccgttaaccttgttacttcccgtaacaccngtaccgtacngtacnccgttggacctacgtacgtagtaagtttcttacgaacttaatttaccgacttagactagagttacnctaaacgttacgtgtacccggtaggtacgtaccgaaaccggttaggaccgtaagtacgttaacgaacggtaactagggttacncggttanaacccgg

SEQ ID NO: 176789 - DNA, 688 bp, Homo sapiens
  misc_feature: GYAE6OF02IYSGS.13.48.E04.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (305)..(305): a, c, t, g, unknown or other
  misc_feature (305)..(305): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctccaggtgccagatgtgccatccagactgaccctagtcctccatcctccctgtctgcatctgtagganacagntcacatcactgccgganagcgaggcatagaatgtaattaggctaggtatcagcaagaaaccagggaacgacccgtaagcctctagactcgtatggtnctagtactaagtttaaaacggtcgggtaccaagtacgaaggttcgacggtcggacgtaaggtacggtactcgtcggaccaacgtacggtacctttactacgtttaccctaactaaccctaacgttacgaacgtaccgtaaccgtcccggttagaacccgtacggtaccgttaacgggtaaactttaccggtttttacgaaccgtttaaaacgtttttaacgtttaaccgttacgttaccggttaaactaaacggttaccttaaaccgtaaactttaacgttaccgtaccggttacgggttacccggttacgggaacccggtaacggaaaccggtaggtaacggtaaactaaccgggtaaacgtagtacgggtagtccgtaacg

SEQ ID NO: 176790 - DNA, 902 bp, Homo sapiens
  misc_feature: GYAE6OF02ITJHJ.13.48.E04.1.454.CMB.1.raw
tcagtcacgtactacacgaccggtgctcgatttagagagcgtcacagagagaaggggggcaggagtcagacccactcaggacacagcatggacatgagggtccccgctcagcctccgtggggctcctgctcgctctggcctcccaggtcgccagatcgtcgaccatccagactcgacccagtcctccacttccctcccgtgtcgtcgctacttcgtaggtaagggagaacacggtactaccaccctactccgtacgtcggaccgggactaacggtccggaacgggtacttaacgttaagaaacgttaggttaagtttacggtacgtaggtactacgaacgtaacggaaaaccggaaaaccgggaaaccgggaaaccgtaccccgttaacgtccgttacgttacggtaccgttacgttaggtaccgggtaacgtaccgttaaccggttaaaacggtttaaaacggggttaaaccgggttaccggtaaccttaacggttaaccggtaacggttacgggaccggtaacgacgggttaagtaccggtaattccggtaacgaccgtaacgtacgttacccgtttaaccttacgtaccctaacctaaccgtaccgtaaccggaccgtaaccggtacccgtaccggttaccgtaacggtaccgttaaacgttagtttaaaccgtttacctttaaacgtttaaaccgttaacgttttaaccgttaccggtttaacttaaaccgttaagttaacctaaacttaccggtttaaaccgtaaccggtttaccggtaccgggttaacccggttaacgggtaaccggaacccggttaaacgggtaaaccggtaaggtaaaccggttaaacccgtaacggtaaccggttaccgggtacgtaaccgacccgttaaccg

SEQ ID NO: 176791 - DNA, 586 bp, Homo sapiens
  misc_feature: GYAE6OF02GFN64.13.48.E04.1.454.CMB.1.raw
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
  modified_base (387)..(387): a, c, t, g, unknown or other
  misc_feature (387)..(387): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttggccggcaagtcgaggcattagaatgatttagctgtancagcaagaaccgaggaacgccctaagctctagattctatggtanctactactaaggtttaaaaggtcgggtacccagtactaaggttcgacggcggcagtggatcgtggacacgagtacctctacttccncaacctatcagacacgcctgcgacgtccgtagtaagttacttttagacttaacgtttacttacgttactacgtaactaagtacttaacaacttaacttacgttccgtaggtaccggttaccggaaccggtaaacgggaaccgtaagggtaacggtaaacgtacccgtaaaacggtaccggtacggttacgaccgtaacg

SEQ ID NO: 176792 - DNA, 821 bp, Homo sapiens
  misc_feature: GYAE6OF02IHA1M.13.48.E04.1.454.CMB.1.raw
  modified_base (211)..(211): a, c, t, g, unknown or other
  misc_feature (211)..(211): n is a, c, g, or t
tcagtcacgtactacacgaccggtgctcgatttagagagcgtcacagagagaaggggcaggagtcagacccactcaggacacagcatggacatgacgggtccccgctcagctccgtggggctcctgctgctctggcctcccgaggtcgccagatgtgccatccagatgaccccagtcctccatccctccctgtctagcatcgtagtagganacgagagtaccactatcacgttcggaccgggacaaggtcgaggacctagttaaagaattacggtatttacggtacgttaggttaacgtacgtaacgaccgaaaacggaaacccggaaaacggggaaacccggtacccccttaacggtaccgttaccgttacgtagttaaccgttaggtacggtacgtaccttaaccggtaaccggtttaaaagggttttaaaaaccggggtccggggttaaccccttaacgtaccggttaaacggttccgtaacgggtacggtcgtaacggtaggtaccgttacggtcgaacgtacgtaacgtactttactaacgttccacgaacctacgtaccaagcctacgtaccgttacggaccgtaccgtcctttaaggtaacctttacggtttactaccgttaaacttttacgttaccgtttacgttaaccttaacggtaattaacgaaccttaaacgtttaacttacccgttaccgggttaccgggttttaaccggaacccgggtaaaccgggtaaaccggtaaacgtttaaacgggtaaagtaacgttaaacccgtaaaccgttaacggttacgggtcgtaccgttaacccgg

SEQ ID NO: 176793 - DNA, 792 bp, Homo sapiens
  misc_feature: GYAE6OF02FPZ6N.13.48.E04.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtagganacagagtcacatctacttcggaccggganaagtcgagggactattagaaatgatttaggctggtatcagtcaagaaaccgagggaaacgaccctaagctctgatctagtggtgactactaccgtaaaggttttaaaaacggcggggttacccaacgtacgtaaacggtttcgaacggtcgggtaccgtaggttacgggtaaacgttccggttacgggtacctaaccgtaacggtacccttttaccgtacgttttaccctaacctaaccctaacgttaaccgacgggtaccgtaaccggtcccgttacgggttaacacccgggttaccgttaaggtaaacggttttacgtttttaacggaacccttttaaaacgttttaacgtttaacccgttcggtttaaacccgtaacgtaaaacgttaaccttaaccttaaaaccgttaaacgttttaacccgtttacccggggtaaccgggtttaaccggggttttaccccggaaacccgggttaaaccgggggtaacccggttaaagggtaacggtaaacgtacccggttaaaaaccggtaccgtgggttaccggtacggtaaccgg

SEQ ID NO: 176794 - DNA, 611 bp, Homo sapiens
  misc_feature: GYAE6OF02IW23U.13.48.E04.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (438)..(438): a, c, t, g, unknown or other
  misc_feature (438)..(438): n is a, c, g, or t
tcagtcacgtactacacgaccggtgctcgatttagagagcgtcacagagagaagggggcaggagtcagacccactcaggacacagcatggacatgagggtccccgctcagctccgtggggctcctgctgctctggcctcccaggtgccagatgtcgccatccagatcgacccagtcctccatccctccctgtctgcatctgtagganacgtagacgtcaccatcacgttcggcccggganacgtcgagggcaagttaagaatgtaagttaggcgttggtatcagcaacgaaaccgagggaaccnccctaagctcgtagtatctagtgtnacgtactacgtaaaggttaaacggcggtaccagtacgtaggtcagcgcgtaggtcgcgtcgtacgacacgtacgtacttcgtactctaccactatcgacgacgaccgcngacctcgtaacgtcgtaagtttactacgtaacttaacgtttattaccgttataccttaacacgttaactacctaacttaacgtaccgttccggtaacggtacgtcccgggaaccgtacgggaaacggttaacggaattaacgaacgtaacgttaacggtcggtacgtactacg

SEQ ID NO: 176795 - DNA, 530 bp, Homo sapiens
  misc_feature: GYAE6OF02GRE1I.13.48.E04.1.454.CMB.1.raw
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
  modified_base (524)..(524): a, c, t, g, unknown or other
  misc_feature (524)..(524): n is a, c, g, or t
tcagtcacgtactacacgaccggtgctcgatttagagagcgtcacagagagaagggggcaggagtcagacccactcaggatacagcatggacatgagggtccccgctcagctcctggggctcctgctgctctggctcccaggtgccagatgtgccatccagatgacccagtctccatcctccctgtctgcatctgtaggagacagagtcacatcacttgccggcaagtcaggcatagaaatgatttaggctggtatnagcagaaaccgagggaaacgcccctaagctctgatctatggtncatccaagtttaaaagtcggggtacccagtactaaggttcagcggcgagtggatctggcacgagacttnactttctcaccatcagacacgctgcgacgcctagaactntttagactaacttattactgtactanaagatacaataattctaccgtggaccggttcggaaccgtaacggggaacctaagggtaggtaaactacgtaaacggtacgtaggtacggntaccgg

SEQ ID NO: 176796 - DNA, 673 bp, Homo sapiens
  misc_feature: GYAE6OF02FXN9P.13.48.E04.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (321)..(321): a, c, t, g, unknown or other
  misc_feature (321)..(321): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctcctgtctgcatctgtaganacagagtcacatcacgttggccgganaagtcgaggcaattagaaatgatttaggctggtatacacgacaacgaaaccgaagggaaacctccccgtaagtcctactagacttacgtagtcggngtactactacgtaaagtttaaaacggtcggtacctagtacgtaaggtcaaggtcggactaggtggtatcgtaggaccaacgtacgtacttcgtaacttccgtaacgtacctactacgagaccgacgtaccctcggaccgacgttaccgaggttaacgttagtttacgtaaccttaaacttttaacttacgttaacgttaacctaacgtaaacgtaacttaaccgtaaacttaaaccgttaccttaccggttacgggttaccggttaccggaacccgggtaaacggaacccggttaaggtaacggtaaacgtaacgtaaaccggttaacgttaggtaccggtacgtaacccgg

SEQ ID NO: 176797 - DNA, 711 bp, Homo sapiens
  misc_feature: GYAE6OF02IYKKM.13.48.E04.1.454.CMB.1.raw
  modified_base (184)..(184): a, c, t, g, unknown or other
  misc_feature (184)..(184): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
  modified_base (446)..(446): a, c, t, g, unknown or other
  misc_feature (446)..(446): n is a, c, g, or t
tcagtcacgtactacacgaccggtgctcgatttagagagcgtcacagagagaagggggcaggagtcagacccactcaggacacagcatggacatggacgggtccccgctcagcctccgtggggctcctgctgctcgtggcctcccaggtcgccagtatgtgccatccagactcgacccagtccnccgactccctcctgtctgctattcgtgtaggacncagatacacactcacgttcggccggtanaacgtcggacggctaagtagtaacgtgtaagttacggtacgtaggtatcganacgtaaacgaacggaacgtaaaccgccccgttaaagccgtactacgtaacgttaccgaagtaccgtnaccgttacgttaacccgttaagtttaaacggaaacggtacccggtccctaagtaacgtaacgttcgaaggtagggtaaacncggtatcggtaacgggctaatttacgtttccttaacgcgtaatcgaacggtctacgcgttcgaacgcgtaaccgtagtaacgattacggcaactaaacgtataacgttgttcggacacggtaccgagttaacgtactaacgttaaccttcgtaaccgttaaccgtaccgttaacccgggtaaatacccggaaacggtaccggttaaaccgacggttaccggtaaaaccgtaacccggttaaacgttaccggtaggttaacccggg

SEQ ID NO: 176798 - DNA, 671 bp, Homo sapiens
  misc_feature: GYAE6OF02H3D2Z.13.48.E04.1.454.CMB.1.raw
  modified_base (331)..(331): a, c, t, g, unknown or other
  misc_feature (331)..(331): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagacgtcaccatcacttggccgggacaagtcgagggctaagttaagaaattgtatttaggcgttaggtatcagacaagaaaccgagggaaaccgtacccctaagtcctcttagacttcgtagtggtnactataccgtaaagttaaaggtcgggtacccatacgtaacggttcaggtcggacgtaggtacgtatcgtacggacaacgtacgtacttctaactttccacctaacctagtacgacgtacgtacgccgttacgccgtacgtacccgtaaggtaacgttacgttttacgaacttaaccgttttacgttaccgttacgttaaccgtaactaaagttacctaaccgtaaacttaacgtttacgttacccggttagggtaacccggttccggaacccggtaaacgggtaacccgtaagggtaacgtaactaaccggtaaacgtacggtacggtacgtcgtaaccg

SEQ ID NO: 176799 - DNA, 539 bp, Homo sapiens
  misc_feature: GYAE6OF02F2YIH.13.48.E04.1.454.CMB.1.raw
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccaggcgagtcaggacattaacaactatttaaatggtatcagcagaaacaggtaaagcccctaagctcctgatctacgatgcatccaatttggaaacngggtacccatcaaggttcagtggaagtggatcgtggacagtatttacttcacatcagcagcctgcagcctgaagatattgctaactattattacngtacagtcgtaatatagaacttaatccgtacccgattaccacccgtttaccggaccgtaaacggggtaccaacggtaacgttagggaacgttaaaccgttaaaacggaaccttaggtacggtaccg

SEQ ID NO: 176800 - DNA, 736 bp, Homo sapiens
  misc_feature: GYAE6OF02GV2TJ.13.48.E04.1.454.CMB.1.raw
tcagtcacgtactacacgaccggtgctcgatttagagagcgtcacagagagaagggggcaggagtcagacccactcaggacacagcatggacatgagggtccccgctcagcctccgtggggctcctgctgctctggctcccgaggtcgccagatgtgccatccagatcgacccagtcctccactccctccctgtcctgcatcgtaggtaggagacgagacgtaccacctatacctacgttcgggaccggactaacggtcgacgggtactaaagttaagaaattgtaagtttacgggtacgtaggtactacgaggaccgaaacggtaaaacccggaacggggtaaacccgtaccccgtaacggtcccttacgttagtacttacttacggtgggtctacctaagttaaccggttaaaggtttaaaacgggtccgggttaccctaacgtaaccgtacgggttacgaacggtacggacgtacggtcggacttccgggtagacctacgtacgtacttctacgttacctacgactagtacacgtacacgtcctgacgtcgtacgtagtacgttactttacgaacttaagttacttacgtactacgtaacgtagtaactaactaacgtttaactaccgttccgggtaacgggtttaccggtaccgggtaaccggtaaaccggggtaacgtaaagggtacctaaacggtaactaaacccggtaagttcgggtacgtagtacccg

SEQ ID NO: 176801 - DNA, 800 bp, Homo sapiens
  misc_feature: GYAE6OF02FRZE6.13.48.E04.1.454.CMB.1.raw
  modified_base (230)..(230): a, c, t, g, unknown or other
  misc_feature (230)..(230): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgaccagtctccatccctccctgtctgcatctggtaggagacagagtccaccatcacttcggccgggnaaggtcagggcattagaatgatttaggcttaggtatcagacgaacgaaaccgaagggaaactcccgtaagccttacttacgtattacgtattgggtacgacgtaacttaaccgttaaaggttttaaaaacgggtccggggtaccctaagttaccggtaaacgggtttaccgaacgggtacgggtaccgtaggggtttacggtaacgttacggttacgggacccgtaaacgtacgggttaacccttttacctaaccgtttttaccaacccctaaacccgtaaccgttaccgaaacggtacccggtaaccggtacccgttaccggacccgtaaccggttacccggtttaaaggttaaacgggttttactttttacgggtaaacccttttaaaaccgttttacgtttaaccgttacgtttaaactaaacggtaacgttaactacttaaaccgttaaacgtttccttaccgggtagggttacccggttacgggaacccgtaaacgggggtaacccgtaaagggtaacgtaaacgttaacggaaaccgttaacgtcgggttaccgagtaacccgg

SEQ ID NO: 176802 - DNA, 563 bp, Homo sapiens
  misc_feature: GYAE6OF02JMPD7.13.48.E04.1.454.CMB.1.raw
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (386)..(386): a, c, t, g, unknown or other
  misc_feature (386)..(386): n is a, c, g, or t
tcagtcacgtactacacgaccggtgctcgatttagagagcgtcacagagagaagggggcaggagtcagacccactcaggacacagcatggacatgagggtccccgctcagctccgtggggctcctgctgctctggctcccaggtgccagatgtcgccatccagatcgacccagtcctccactccctccctgtctgctatcgtggtaggagacagacgtcaccatcacgttcggccggacagtcgaggctataagaatagtagttaggnttggatcgagtcaagaaaccagggaaacncccgtaaagccttatacgatctatggtancatactaagttaaacgnggtacccagtacaaggttcaggtcgagtagtgactcgagacanacgtacttcattcactacatcatcagccagcagtctagtacgttacttacgacttacttacttactactactaactaactataactactaagttacgtacgtacggtaccgtacggaccgtaacgggaccgtaacggtacgaacgtacgaaacggtacgtacggtacgtacgtacgg

SEQ ID NO: 176803 - DNA, 719 bp, Homo sapiens
  misc_feature: GYAE6OF02HRKCG.13.48.E04.1.454.CMB.1.raw
  modified_base (206)..(206): a, c, t, g, unknown or other
  misc_feature (206)..(206): n is a, c, g, or t
tcagtcacgtactacacgaccggtgctcgatttagagagcgtcacagagagaagggggcaggagtcagacccactcaggacacagcatggacatgagggtccccgctcagctcctggggctcctgctgctctggcctcccaggtgccagatggtgccatccagatcgacccagtcctccatcctccctgtctgcatctggtagganacagagtcaccatctacttcggccggacaagtcgagggacagttagaaatgtatttaggctggtatcaagacaacgaaaccgaagggaaacgtcccctaagcctcttagacttctaagttggtcgactaacttaccgttaaaggttttaaaaacggtcgggtacccctaagtaccgtaaaggtttcgaacggtcggacgtagggtacgacgttacggtcggactaacgtacgttaaccgtttctaacgtttccctacgaaccctataaccgtacgccgtaacgtccgtagaccgtacggccttacggaaacgtttcttttacggaaccttaaacgttttaacgttaccgttcgtaaccgtaaacgtaataaccgtacctaaacgttaatttaccggttaccgttaacggggttacccggttaaccgggaacccggtaaacgggaacccgtaaagggttaacggaaaacgtacccggtaaaacggtaaccggtaggtaccggtactaacccggg

SEQ ID NO: 176804 - DNA, 682 bp, Homo sapiens
  misc_feature: GYAE6OF02FJLAR.13.48.E04.1.454.CMB.1.raw
  modified_base (628)..(628): a, c, t, g, unknown or other
  misc_feature (628)..(628): n is a, c, g, or t
tcagtcacgtactacacgaccggtgctcgatttagagagcgtcacagagagaagggggcaggagtcagacccactcaggacacagcatggacatgacgggtccccgctcagctccgtggggctcctgctgctctggctcccgaggtgccagatgtgccatccagatcgacccagtcctccactccctccgtgtctgcatcgtaggtacggagacagacgtcaaccatctaccgttggacccgggataacggcgagggctaagttaagaaagttgtagtttaggcttaggtactacgagtcgaaacggaaaccgtacggaaaaccgtaccccgtaagccgtaccgtagtacgtaacgtacgtatacgtacctaacgttaccgtaaaggttttaacggaaaccggtacgggttaccctaagttacggtaacggttacgtaggtaacggaaggtacggttactacggtaggtaacgttagtttacgttttaaccttaccctacgtactacgtacgtaccgtacgtcccgttgaaccgtacgtaccgtaagtaacgttacgttaagttaccgactaacgttacttacgtacgtgtacagtactagtatacgtaataccgtaccgtactaccncgttaaccgtcgaaccgagaccgagtacgacgtaagtaacgtacgtagtgtacg

SEQ ID NO: 176805 - DNA, 719 bp, Homo sapiens
  misc_feature: GYAE6OF02HBVPZ.13.48.E04.1.454.CMB.1.raw
  modified_base (290)..(290): a, c, t, g, unknown or other
  misc_feature (290)..(290): n is a, c, g, or t
tcagtcacgtactacacgaccggtgctcgatttagagagcgtcacagagagaagggggcaggagtcagacccactcaggacacagcatggacatgagggtccccgctcagctccgtggggctcctgctgctctggcctcccgaggtgccagatgtgccatccagactcgaccctagtcctaccatccctccctgtctgctactcgtaggtacggagtacaggtactccacactctacgttcggccggacagtcgaggtactagttaagaagtgtagtttaggcgtagtancgaagacgaacggaaaccggaacgggaaccgtacccccgtagtccgttactagtacttacgttagtgtactacacttaccgtaaaggtttaaacggtccggtaccacgttaacgacggttcgacggccggtacgtaggtagtaccgtcgtacgtacgacacgtacttctaccgttactaccctaccgacttaccgacgtcgaccgtaccgtacgaccgtacgtcggttaaacgttaacgttacgtttaacctaacgttaacgtttaccgtttaccgtacgttaaccaacgttaacgtaaccgttacaaacgttacgtttaacgtccgggttaacggttaccggtaccggtaaccggtaacgggaaaccggtaacgggttaacgaaaccggtaacctaaaccgggttacggtacggttacggaactccgg

SEQ ID NO: 176806 - DNA, 799 bp, Homo sapiens
  misc_feature: GYAE6OF02F97PN.13.48.E04.1.454.CMB.1.raw
  modified_base (146)..(146): a, c, t, g, unknown or other
  misc_feature (146)..(146): n is a, c, g, or t
  modified_base (214)..(214): a, c, t, g, unknown or other
  misc_feature (214)..(214): n is a, c, g, or t
tcagtcacgtactacacgaccggtgctcgatttagagagcgtcacagagagaagggggcaggagtcagacccactcaggacacagcatggacatgagggtccccgctcagctccgtgggctcctgctgctctggcctcccgaggtnccagatgtgccatccagatcgacccagtctccacttccctcctgtctacgctatcgtaggtaaggganacgagacgtaccaacctatccgtaacgttcgggacccgggactaaaggtccgaaggggtacctaaagttaaagtaaacgttaggtaagtttacgggtacgttagggttaactacgtaacgacgaaacggtaaaacccgaaggggaaacccgtaaccccgtaagtccttacgttaagacttacgtagtaggtactaccgtaacgttaaccgttaaaaggtttaaaaccgggtaccggtaacctaaagtaccggttaaacgttacggacggaggtacgtacggttaaggctacggtaacggactaacggtagtaccttagtactctaaccactactacgaacgaccgacgaccgtacgaactacggtactacgttaacgttaacgtttacgtaacctaacgttttaactttaccggttacgttaaacgtaaaccgaacgttaactaacgtaaaccttaacgttaccgttaccgggttaaccgggtaccgggttaaccggaacccggtaaacgggtaaccgtaaacgggttaaacggtaaacgtaacccggtaaaaccgtacggttaacgggtacggtacgtaaccgg

SEQ ID NO: 176807 - DNA, 822 bp, Homo sapiens
  misc_feature: GYAE6OF02GG7UF.13.48.E04.1.454.CMB.1.raw
tcagtcacgtactacacgaccggtgctcgatttagagagcgtcacagagagaagggggcaggagtcagacccactcaggacacagcatggacatgagggtccccgctcagctcctggggctcctgctgctctggctcccaggtcgccagatgtgccatccagatcgacccagtctaccatccctcccgtgtctgactatcgtggtaaggacgaacgaggtacttaccaaccaattccgtaaccgtttcgggacccgggactaaacggtcggaacggggtactaagtttaaaggaaaagttcggtaacgtttttacgggaccttagggttaacttccgaaggacccgtaaaccggtaaaaaccgggaacggggtaaaacccgtaccccggttaaacgtccgtttaacgttgtaacgtttaccgttaggtcggtacggaacctaacggttaacgttaaaacgggtttaaaacggtccgggtaccctaagtacggtaacggttacgacggacggtacgtaggtagtacgtcgtacgtaccaacgtacgtacttactaacgttccaccgtaactcgacgtacgtagacccgtacgtagtaccggaccgttacgttaacggttaagttttacctttaccgggtaacctttaaacgtttaccgtttagtacccgtttaacgtaaacgtaaccttacttaaacccgtaaactttaacgttacccgttaccgggttacggtacccgggtaaccggttaaccgaacggggttaaaaccgtagggttaaccgaaacgtaaccgtaaccgggtatcggtacggccttaaccgg

SEQ ID NO: 176808 - DNA, 524 bp, Homo sapiens
  misc_feature: GYAE6OF01B40AM.10.35.D02.1.454.CMB.1.raw
  modified_base (523)..(524): a, c, t, g, unknown or other
  misc_feature (523)..(524): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaaagaacaccgtgtatctggaaatgagcagcctggaaagcgatgacacaggactctattattgtaccactaagagtcccaacgaagactgtgggaaagggactgctggggccagggagcccttgtcaccgtctcctcagcctccaccaagggcccatcggtcttccccctggccgccctgctccaggacgccacctccgagacgcacagccggccctgggcctgcctggcaaggctaccttcccactactatcgctgacgcgggctggcaaggcgacatgnn

SEQ ID NO: 176809 - DNA, 527 bp, Homo sapiens
  misc_feature: GYAE6OF01E26QD.10.35.D02.1.454.CMB.1.raw
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaancgatgacacaggactctattattgtaccactaagagtcccacgaagactgtgggaaggactgctgggccagggancccttgtcaccgtctcctcagccctccaccaagggccccatccggtccttcccccgtggccgcccctcgcctccacggacgcaccctccgagacgcacagccggccctgggcctgcctggtcaaggactactcccactactatcgctgacgcgggctggcaaggcganatgn

SEQ ID NO: 176810 - DNA, 543 bp, Homo sapiens
  misc_feature: GYAE6OF01CC5D6.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaggggctggagtgggttggccttattagagcagacctgatggtggacacagagtacgctggattcgaaaaggcagattcgcatctcaatgatgagtcaaagacacgtgtatctaggaatgagcagcctaggaaagcgatgacacaggactactattactagtacctactaagacgttccccaacggaagtaccgtaggtacggggaaggactgggccgtacgggggg

SEQ ID NO: 176811 - DNA, 582 bp, Homo sapiens
  misc_feature: GYAE6OF01BE82L.10.35.D02.1.454.CMB.1.raw
tcagcatagtagtgcacgaccggtgctcgatttagcacacgatagttgggtttggggagctctgggagaggagccccagccctgggattcccaagtgtcttcattcacgtgatcaggactgaacacgagaggactcaccatggagtttgggctgaggtggattttccttgctgcaattttaaaaggtgtccagtgtgacgtgcagttggtggagtctgggggagcttggttaagccgggggggtcccttagactctcctgttcagcctctggattcagtgtcactaacgcctggatgagctgggtccgccagtccccgaggggaggggctgggagtgggttggcttagttagaagcagacctgatggtggacaacgagagtacgctggattacggtaaaaggcagtacttcgaccatctacaattgatgagtacaaagacaccgtgtatcgtaggaatgaagcagccgtagggaagcgaatgacacgaggactactagttacttacgtaacccaacttaaacggaccgttaccccgaacggtaaacggaacgttagggtaacggggaaagggtcgtacgggg

SEQ ID NO: 176812 - DNA, 618 bp, Homo sapiens
  misc_feature: GYAE6OF01C1FJP.10.35.D02.1.454.CMB.1.raw
  modified_base (466)..(466): a, c, t, g, unknown or other
  misc_feature (466)..(466): n is a, c, g, or t
tcagcatagtagtgcacgaccggtgctcgatttagcacacgatagttgggtttggggggagaggagccccagccctgggattcccaagtgtcttcattcagtgatcaggactgaacacagaggactcaccatggagtttgggctgaggtggattttccttgctgctaaattttaaaaggtgtccagtgtgacgtgcagttggtggagtcgtggggggaggcttgggttaaggccgggggggtccttaggactctcctgttcagtcctctggattcagtgtcactaacgcctggatgagcgtgggtccgccaggtccccgagggggaacgggctgggaggtgggttggcctttagtagaagcagacctggagtgggtagggacaacgagacgtacgctaggattacggtaaaaggcaagattacgcctatcctctaattgatgaagtacaaaagacaccgtgtactntaggaaatgagcaagccgtaaggaaagcgaatcgaacacgaggtactactattattacgaacctaacgtaacggtaccgtacccgaacggtaaacgacgttagggacggggtaaacgggtaacgtagggtacgtcgggggccgtaacggggg

SEQ ID NO: 176813 - DNA, 635 bp, Homo sapiens
  misc_feature: GYAE6OF01DBFK8.10.35.D02.1.454.CMB.1.raw
  modified_base (267)..(267): a, c, t, g, unknown or other
  misc_feature (267)..(267): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggaggcttgggttaaggccggggggtcccttagactctcctgttcagcctntggattcagtgtcactaacgcctggatgagctggggtccgccacggtccccgaggggaacggggctgggaggtgggttgccttattagaagcaaggacctgatggtagggacaacgagagtacgctggattacgaaaggcagattcgacatctacaattgatgagtacaaaagacacgtagtatacgtaggaatgagcagaccgtagggaaacgtacgaagtcgaacacgacgggaacttacttaagttagttacgtaaacccgtaacgttaaacgaacggttacccccgaaacgggtaaaccgtaaccggttacggggttaacgggggtaaaggggtaaccgttcggggccggttaacccggggggg

SEQ ID NO: 176814 - DNA, 608 bp, Homo sapiens
  misc_feature: GYAE6OF01BKB6V.10.35.D02.1.454.CMB.1.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttncagcacaaacctggccaggctcccaggctcctcatctttgatgctttcaacacgggcccctggccgtcccaggcagggttcaggtggcaggtgggtctgggacagacttcactctcaccatcagcagcctagacgcctagaagtatttgctagtttattactgtacagctagcgtcgccctacgtttcgggcgggtacgggtcgcccgtacgtttccgggaccgggtaaggggtaacccaaaaagtacggaacgggttaccgaaaacgggtaacgttgggtagggccgttcggaccctaacccgtacgttccgttacggttacctttccgaacgtttcccgttacccccgg

SEQ ID NO: 176815 - DNA, 577 bp, Homo sapiens
  misc_feature: GYAE6OF01ESC85.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaaggccggggggtcccttaggactctcctgttcagcctctggattcagtgtcactaacgcctggatgagctgggtcccgccagtccccgaggggaggggctgggaggtgggttggccttagttagaagcagacctgatggtgggacaacagagtacgctggattacgaaaaggcagacttcgcctatctacaattgatgagtacaaagaacacgtatatcgtagaatgagcagcctaggaagcgtagcgacacgaggtactacttattacttagtaacccgtaacgtaaagacgtaccccaacggaagtaaccgtcggtaacggggaagggactgggcggtacgggggg

SEQ ID NO: 176816 - DNA, 544 bp, Homo sapiens
  misc_feature: GYAE6OF01BU8OA.10.35.D02.1.454.CMB.1.raw
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (533)..(533): a, c, t, g, unknown or other
  misc_feature (533)..(533): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaagccggggggtcccttagactctcctgttcagcctctggattcagtgtcactaacgcctggatgagctgggtccgcagtccccgagggagggctggagtgggttggccttatagagcagacctgatggtgggacaacgagagtacgctggattacgaaaaggcagattcgcatctcaattgatgagtacaaagacacgtgtatctagaatgancagcctaggaancgatcgacacaggactctattatacgtaacctacgtaagactccccaagaagtaccgtagggtagggaacgggactggnggtaccggggg

SEQ ID NO: 176817 - DNA, 602 bp, Homo sapiens
  misc_feature: GYAE6OF01DV5HA.10.35.D02.1.454.CMB.1.raw
  modified_base (362)..(362): a, c, t, g, unknown or other
  misc_feature (362)..(362): n is a, c, g, or t
  modified_base (469)..(469): a, c, t, g, unknown or other
  misc_feature (469)..(469): n is a, c, g, or t
  modified_base (591)..(591): a, c, t, g, unknown or other
  misc_feature (591)..(591): n is a, c, g, or t
  modified_base (600)..(601): a, c, t, g, unknown or other
  misc_feature (600)..(601): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagcctaggaaagcgatgacacaggactctattattgtaccactaagacgtcccagaagactggtagggaagggactggcgtgggccaggggacncccgttgtccaccgtctcctcacgccctccaccgaacgggcccagtccggtccttcccccgtggccgcccctcgcctccgacggacgccaccctccgagacgccacncggccggcccgtcgggcctacggcccgtacgggtaccgaacggtacccttacccgttcccctaacttacctaagttcgccgttaggacggtcccggggcgttcgggaccgaaacgggccganaacgtaggnng

SEQ ID NO: 176818 - DNA, 577 bp, Homo sapiens
  misc_feature: GYAE6OF01AOUSP.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttgggttaagccggggggtcccttagactctcctgttcagcctctggattcagtgtcactaacgcctggatgagctgggtccgccacggtccccgagggaaggggctgggagtgggttggccttagtagaagcagacctgatggtggacaacgagagtacgctggattacgtaaaaggcagattcgacatcacaattgatgagtacaaagaacacgtatatcgtagaactgagcagccgtaggaagcgtatcgacacgaggactctaatttactacgtaacctaacgtaaggacgttaccccgaaagaacggtaccgttagggtacggggaaaggggtcgtgggcggtaccgggggg

SEQ ID NO: 176819 - DNA, 630 bp, Homo sapiens
  misc_feature: GYAE6OF01ENSUY.10.35.D02.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctccagaaaccaccggagaagttgtgttgacgcagtctccaggcacctgtcttgtctccgaggggaaangccaccctctcctgcagggccagtcactatgttagtgacaactacttagccttggttncagcaacaaacctggccaggcctccaggcctcctcatctancgctgcactccatcgacgggccacgtggacacgtcccaggcagtattcgaggtcggctaggtgggtactggggactagaccttcgactctacaccatccacgcacgacgttcggacgcgtaggtaagttagtttcgactacggttacttaagtttacgttcgtactaacgtaccgtaagttacgttacggtacccgtaacccggttaacccgtaaacggttaccgttttccgggaaccgtaacggggtaacccaaaggtccggtagggaacgtaacgtaaccgtaaaaccggtacgtacggtacggtaccgtagaccgtaacgtacgttaccg

SEQ ID NO: 176820 - DNA, 572 bp, Homo sapiens
  misc_feature: GYAE6OF01BFUID.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggagcttggttaaggccggggggtcccttagactctcctgttcagcctctggattcagtgtcactaacgcctggatgagcgtgggtccgccaggtccccgaggggaaggggcgtgggaggtgggttcggccttatagaatcagtacctgatggtcgggaacaacgagagtacgctaggattacgtaaaaggcaagattcgcatctacaattgatgaagtacaaagacacgtgtatcgtaggaatggagacagaccgtaggaacgcgtaatgaacacgagactactattatacgtaaccaacgtaagacgtacccaaggtaacgacgtaggtagggaacggtacgtggcggtacgggg

SEQ ID NO: 176821 - DNA, 658 bp, Homo sapiens
  misc_feature: GYAE6OF01APVVS.10.35.D02.1.454.CMB.1.raw
  modified_base (198)..(198): a, c, t, g, unknown or other
  misc_feature (198)..(198): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcacctgtctttgctcgaggggaaangccacctctcctgcagggccagtcactatgttagtgacaactacttagcctggttgcagcaacaacctggccaggctccaggctcctcatctatcgctgcatccatcgacggccagtcggacacgtcccgaggcaagtacttcgaggtggcgtaggtcgggtactaggggacagtaccgttcaccttccacaacctagtccgaacgtcgaacggtaccgtacgggaacgtaccgtaggtaaacgttcgtttacgacgttacgtttacttaacgttacgttcgtacgtacgtcgtaaggttacgtacggtaccgtaaccgttacccgtaaaggtttaacccgtttcgggaacccggtaacggggtaaccctaaacggtaccggtacggaacgttaaccggtaaaccgtaaaaccggtaacgttacggtacgggtactacgaacccgtaaccgtcgttaccg

SEQ ID NO: 176822 - DNA, 758 bp, Homo sapiens
  misc_feature: GYAE6OF01BF9F0.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctggaggtggtattttccttgctgctaattttaaaggtgtccagtgtgacgtgctagttggtggagtcgtgggggaggtcgttgggttaaggccggggggtccttaggactctccgtgttcagtcctcgtggtacttcgagtgtacactaacgcctggatgagcgtgggtccgccgacgtcccgaaggggagggccgtaggaggtgggttcggccttaagtagaagcaggaccgtgagtggtaggacaagagacgtacgcgtagggtaacttacggtaaaaaggctaaggtacgttccgacctaagttccgtactaagtttacggaagttacggtaacgtaaccaaaaacggtaaaccgtaacccgtttaagttaaccgttacgttaaagggtaaacgtacggaacggtaaccgtaacggaacccggttaagggaaaccggtacggtaagtaaccggaacgtaacggtacggtaaccgttaacttaacgtttacttaaccggttaaaccgtaaccgttaaaggtaacccgtaaccccgaaaacggttaaacggtaacggtttacggggtaaggggaaaaccgggtacggtgggtaacccggggtaccgggggg

SEQ ID NO: 176823 - DNA, 563 bp, Homo sapiens
  misc_feature: GYAE6OF01BAVFS.10.35.D02.1.454.CMB.1.raw
  modified_base (304)..(304): a, c, t, g, unknown or other
  misc_feature (304)..(304): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaagccggggggtcccttagactctcctgttcagcctctggattcagtgtcactaacgcctggatgagctgggtccnccagtcccgagggagggctggagtgggtgccttatagagcagacctgatggtaggacaacgagagtacgcgtaggattacggtaaaaggctagacttacgcatctactaattgatgagtacaaagaacaccgtgtatactaggaatgagcagccgtaggaagcgatagacacgaggtactacttagttattagtaacccacgtaagaccgtacccgaacgaagacttacgggacgggaagggtacgtggcggtacgggg

SEQ ID NO: 176824 - DNA, 528 bp, Homo sapiens
  misc_feature: GYAE6OF01CWYZX.10.35.D02.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (258)..(258): a, c, t, g, unknown or other
  misc_feature (258)..(258): n is a, c, g, or t
  modified_base (371)..(371): a, c, t, g, unknown or other
  misc_feature (371)..(371): n is a, c, g, or t
  modified_base (519)..(519): a, c, t, g, unknown or other
  misc_feature (519)..(519): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccaggggaaangccaccctntcctgccagggccagtcactatgttagtgacaactacttagcctgggttncagcacaaacctggccaggctcccaggctcctcatctatgctgcatccatcagggccagtggcactcccaggcagattcgagtgcaggtgggtctgggacagtacttcactcncacctatcacgctagacgtaggagccgtaggagtatttgctagtcttatttactgtcagctagttacgtgtccacgtccctaagtacctttcggaccgacgggaccagacgtaggagactacgaaacgtaacgtggtcggtactgacncgtattacg

SEQ ID NO: 176825 - DNA, 676 bp, Homo sapiens
  misc_feature: GYAE6OF01C4D7P.10.35.D02.1.454.CMB.1.raw
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (578)..(578): a, c, t, g, unknown or other
  misc_feature (578)..(578): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttcctgctgactaattttaaaaggtgtccagtgtgacgtgcagttggtggagtcgtgggggagtcgttagggttaacgggtccggggggtacccttaggactcgtccgtgttcacgtcctcgtggtattcgagtgtcacgtaacgcctggatggacggcgtcgggtcccgcccgacggtccccggaggggaaggggctgggaggtgggttcggccttagtagagcagacctgagtggnggacaaagnggagtacgcgtaggtattaacggtaaaaggctaaggtacttcggacctactacgtactaacgttgaacttaggtaacgtaacgaaaagtaactaaccggttagtaacgtacgtaaggaaatagtagacgtacgacgtaaggtaacgagtaagtacgaacgtacgaggtaacttnttaagttaacttacgtaaaccgtaactaacggtaaccgtacccgaaggtaaacggtacgtgggtaaacgggaacgggtacgttgggcgggtacggggg

SEQ ID NO: 176826 - DNA, 598 bp, Homo sapiens
  misc_feature: GYAE6OF01AQ4F1.10.35.D02.1.454.CMB.1.raw
  modified_base (359)..(359): a, c, t, g, unknown or other
  misc_feature (359)..(359): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaaatgagcagcctggaaagcgatgacacaggactctattattgtaccactaagagtcccagaagactgtgggaaggactggcgtgggccaggggacncccgttgtccaccgtctcccgtcacgccctccaccaacgggcccacgtccggtccttcccccgtcggtcccgccccgtgccctaccgacggacgccgacccgtccgacgacgcacgacgccggtcccgtacgggccgtcgcccgttcggtaccaacggtacctaccgttccccaccttaactactggtccgttggacggtccgggcgtcgggaccgtaacgggccgaccaagtacgctg

SEQ ID NO: 176827 - DNA, 578 bp, Homo sapiens
  misc_feature: GYAE6OF01CIR5Y.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaaggccggggggtcccttagactctcctgttcagcctctggattcagtgtcactaacgcctggatgagctgggtcccgccacggtccccgaggggaacggggctgggaggtgggttggcctttagtagaagcagacctgagtggtgggacaacgagacgtacgctggtattcggtaaaaggcagtattcgcctatctcaattgatgagacaaagacacgtgtatcgtaggaatgagacagcgtaggaagcgagtacgacacgacggtacttacgtattacttcgtaacctacgtaagacgtacccagtaacgtaccgtagggtacgggaaggtacgtggtcggtacgggg

SEQ ID NO: 176828 - DNA, 618 bp, Homo sapiens
  misc_feature: GYAE6OF01ERE63.10.35.D02.1.454.CMB.1.raw
  modified_base (613)..(613): a, c, t, g, unknown or other
  misc_feature (613)..(613): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtacaaagacaccgtgtatctaggaaatgagcagcctaggaaagcgatgacacaggactctattattgtaccactaagacgtacccagaagactggtagggaagggactggcgtgggccaggggctcccttgcaccgtctctcacgtccctccaccgaacgggccctacgtccggtccttccccctggcccgcccgtcgcctcccgacggacgcctaccctccggagaccgcgaaccacggtccggacccgtcggggcctacggtcccgttgggtacccaacgggtacccttacccgtacccaaccttacgtacttacgtccgtagggacggccggggtccgtacgggaccgaaacgggtccgaactacgtacgngtacg

SEQ ID NO: 176829 - DNA, 578 bp, Homo sapiens
  misc_feature: GYAE6OF01B3KGB.10.35.D02.1.454.CMB.1.raw
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (514)..(514): a, c, t, g, unknown or other
  misc_feature (514)..(514): n is a, c, g, or t
tcagcatagtagtgcacgaccggtgctcgatttagcacacgatagttgggtttggggagctctgggagaggagccccagccctgggattcccaagtgtcttcattcagtgatcaggactgaacacagaggactcaccatggagtttgggctggaggtggattttccttgctgcaattttaaaaggtgtccagtgtgacgtgcagttggtggagtcgtgggggaggcgttggttaaggccggggggtcccttagactctcctgttcagcctctggattcagtgtcactacgctggatgagcgtgggtccgccacggtccccgaggggaacggggcgtgggaggtgggttggcctttagttagaagcagacctgagtgggtgggaacaacgaggagtacggctaggtagttaacggtaaaaggcaaggtattccgactatctactaagttagatgagtaacaaagaacaccgtatactctaggaatgagnagcgaggaagngatgacacgagactntaattagtcgtaaccagtaacgacgtacccaacgaagtacgtagggtagggaagggtcgtcggg

SEQ ID NO: 176830 - DNA, 611 bp, Homo sapiens
  misc_feature: GYAE6OF01DZSD1.10.35.D02.1.454.CMB.1.raw
  modified_base (607)..(607): a, c, t, g, unknown or other
  misc_feature (607)..(607): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtacaaagaacaccgtgtatctaggaaatgagcagcctaggaaagcgatgacacaggactctattattgtaccactaagacgtcccagaagactggtgggaaggctgcgtgggccagggagcccgttgtcaccgtctcctcacgccctccaccgaacgggcccacgtcccggtcccttccccccgtcggcccgtccccgtcgccctaccgacgggacgacctaccccgtccggaacgacgccaacgacggcccggcccgtcggggcgtcggccgttcgggtaccaacggtacccttaccttccccgtaactaccgttacgtcgtccgtaggacggtcgggacgtcggaccggaacggccgagacgtgngacg

SEQ ID NO: 176831 - DNA, 644 bp, Homo sapiens
  misc_feature: GYAE6OF01DNMPA.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggaggtcgttgggttaaaggccgggggggtcccttagactctcctgttcagcctctggattcagtgtcactaacgctggatgagcgtgggtccgccaggtccccgaggggaagggctgggagtgggtgcttagtagagcagacctgagtggtgggacaacgagagtacgcgtggaattacgtaaaaggctaagtagttccgaccattcctactaattggattagaagtaacaaaagtaacaccgtagtaactcgtaaggaaatcggaagtcaaggacccgtaagggaaacgcgtaagtacgaacaacgacggtaacttacttaattacgttacgtaaacctaacggttaaagacgttaccccgaaggtaaaacggtaccgttagggtaacggggggaaacggtaccgttcgggtacggtaccgggggg

SEQ ID NO: 176832 - DNA, 634 bp, Homo sapiens
  misc_feature: GYAE6OF01EXJ10.10.35.D02.1.454.CMB.1.raw
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (488)..(488): a, c, t, g, unknown or other
  misc_feature (488)..(488): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttcctgctgcaattttaaaaggtgtccagtgtgacgtgcagttggtggagtcgtgggggagtcttgggttaaggccgggggtccttagactctcctgttcagcctntgattcgngtgtcactaacgcctggactgagcgtgggtccnccgacgtccccgaggggacggggctgggtaggtgggttcggcctttagtaggaagcgagacctggagtggtgggaacaagagagtcgacgtaggtacttacgaaaaggcgaagtacttcggactatactacaagttgatgtaagtaacaaagaccgaccgtgtaactgtaaggtaaatggaacncgaacgtcgtaacggaaagcgtaagtcgaacaagacggtactagttaacgttacgttaagtacccgtaaacgtaagtaaccgaaccccgtaagtaaacgtaacggtacgggtacggggtaaaggtcgtacgggcggtaaccggggg

SEQ ID NO: 176833 - DNA, 657 bp, Homo sapiens
  misc_feature: GYAE6OF01EHK1L.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgactaattttaaaaggtgtccagtgtgacgtgctagttggtggagtcgtgggggaggtcgttgggttaacgggcccggggggtcccttagacctcctccttgttcagcctcgtggtattcagtgtcactaacgcctggatgagcgtcgggtccgccgacgtccccgaggggacgggctgggagtgggtgcttagtagaagcagtaccgtgagtggtggaacaagagagtacgcgtaggagttacggtaaaaggcaaggtacttaccgaccgtattacctactaagttagaagtgaacgtaacaaaacggtaacccgtaccggttagttaacgtacgtaaggaaacgttggaacgacgtacggaccgtaagggaaacgacggtagtacgacgaaccaagggtacttaccgttatttacgtacgtaccaacgttaacggacgtaccccgaagtaacgacgtagggtacgggaaggtacgtggcggtacggggg

SEQ ID NO: 176834 - DNA, 811 bp, Homo sapiens
  misc_feature: GYAE6OF01A8SR8.10.35.D02.1.454.CMB.1.raw
tcagcatagtagtgcacgaccggtgctcgatttagcacacgatagttgggtttggggggagaggagccccagccctgggattcccaagtgtcttcattcagtgatcaggactgaacacagaggactcaccatggagtttgggctgaggtggattttcctgctgctaattttaaaggtgtccagtgtgacgtgctagttggtggagtcgtggggaggtcgttgggttaacggcccggggggtcccttagacgtcctccgttgttcgacgcctcgtggtacttcgagtgtaccaacgtaacgccgtaggatcggacgtccgtacgggtcccgaccgacggtacccccgagggggaacgggccgttagggaggttcggggtttacggtaccgttttaagttaaggaacgtccgtaaacggtacccgttaggaggttcgggtaacggggaaacaaacggaacgggtaacgggtaaccgcgtttaaggaacgtttaaacggtaaaaggtacgtaagtaacgtttaccgaccttaacgtacgtaactaaagttgaagttacgtaaggtaaaccgaaaagtaaaccgtaaccggttagtaagtacgttaaggaaagtaggtaacgacgacgtaccgtaggaaacggtacgagtaacgaaccgtaacggtacgtaaccgttacgtaacgtttaagttaacgtaaaccgaaccgttaaaacgacccgttaacccgaaacggttaaacgaaccggtaggggttaacggggtaaacgggtaccggtaggtacccgggttagggggtacccggtaaaccgggg

SEQ ID NO: 176835 - DNA, 652 bp, Homo sapiens
  misc_feature: GYAE6OF01BXHY9.10.35.D02.1.454.CMB.1.raw
  modified_base (647)..(647): a, c, t, g, unknown or other
  misc_feature (647)..(647): n is a, c, g, or t
tcagcatagtagtgcacgaccggtgctcgatttagcacacgatagttgggtttggggggtcccgttacgactctcctgttcagcctcctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtacaaagaacaccgtgtatctaggaaatgagcagcctaggaaaagcgatagaacacgaggacttctaatttaattggaaccacgtaaaggacgttccccaagaaagacctggtaggggaaaggacctggccgtggggaccaaggggacgcccctttgtcccaaccgttcctcccgtacacgcccctaccgaccgaacgggcccacgtccggtcccttcccccgtcggacccgccccgtcgtccgtcccgaacggacgccacccgtacccgacgacgccgacgaccggccggccctacgggccgtcggtccgtacggtacgaacggtacctaccttaccctacctactacgtcgccgttaggacggccgggtaccgagggaccgaacgggccgaacgagttacggngtacg

SEQ ID NO: 176836 - DNA, 563 bp, Homo sapiens
  misc_feature: GYAE6OF01EKUGX.10.35.D02.1.454.CMB.1.raw
  modified_base (464)..(464): a, c, t, g, unknown or other
  misc_feature (464)..(464): n is a, c, g, or t
  modified_base (497)..(497): a, c, t, g, unknown or other
  misc_feature (497)..(497): n is a, c, g, or t
tcagcatagtagtgcacgaccggtgctcgatttagcacacgatagttgggtttggggggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttggttaagccggggggtccttagactctcctgttcagcctctggattcagtgtcactaacgcctggatgagctgggtccgccagtcccccgaggggaaggggctgggacggtggggttggccttagttagaagcagacctgatggtgggacaacgaggacgtacgcgtaggatttacggaaaaggcagtatcgaccattctacaattgatgaagtacaaaagacacgtgtatcgtaggaaatgancgagccgtaggaagacgagtgacacgaggactntattatagtaccataagagtacccagaacgacgtgagggtaaggactaggcgtggggctaacgggg

SEQ ID NO: 176837 - DNA, 630 bp, Homo sapiens
  misc_feature: GYAE6OF01BB5U5.10.35.D02.1.454.CMB.1.raw
  modified_base (628)..(628): a, c, t, g, unknown or other
  misc_feature (628)..(628): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattacgtaaaaggcagattcgccatctcaattgatgagtacaaagaacaccgtgtatctaggaaatgagcagcctaggaaagcgatgacacaggactctatttattgtaccaataagactacccaacgaagactaggagggaaggactggcgtgggccgaggggacgtcccgttgtccgaccgttcctccgtcgacgtccctacccgaaccgacgggcccctacgtcccggttcccttcccccgtcggtcccgtccccgtcgacccgttcccgacgggtacacccgacccgtaccggacgacgacccgaacgaccggcccggcccgtcggggcctcggtcccgttgggacctaacggtaccttaccgtccctaactacctagtcgcgtggacggtcgggctcgggacgtaacggccgacgagcgncg

SEQ ID NO: 176838 - DNA, 994 bp, Homo sapiens
  misc_feature: GYAE6OF01CS4I0.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctggaggtggtattttccttgctgctaattttaaaaggtgtccagtgtgacgtgctagttggtggagtcggtgggggaggtcgtttagggttaacgggtcccgggggggttaccccttaggtaccttccgttcccgttggtttccgacgtcccgttccgttaggtatttcgtaggttcgtaccaaccttaaccggcctaggagttacggacggtccgttcggggtcccccgacccggtaacccgggttaccccccggaaggggggtaaccgggggtccgttaggggtacggggtttcgggggttttaccgggtacccgtttttaaagtttaacgggaaacggtaccggtaaaccgggttaacccgttagggtaaccgggtttaggggtttaacgggggaaaacccgtaaaacggtaaacgggtaacgggtttaacccgggtaccggttaaggggttaaaaccgttttaacccggggtaaaaaaagggtccgtaaaggttaccgtttacccggaccgttaactttaccgttaaccgttaaagtttaggtaaacgttacggttaaacggtaaccgtaaaaaacggtaacccgttaacccggtttaacggttaaccgttaaccggtaagggtaaacgttacggaaccggacgtaacgggtaacccggtaaggggaaaacgggtaccggtaagttacccggaaacccgtaaccggaacgttaacctttacgttaacgtttaaaccgttaccgtaaacccgtaaacgttaacgtaaccccggttacccgaaagtaacccggaacggttacgggtaaggggtaaccgggtacgtcggggaccggttaacgggggg

SEQ ID NO: 176839 - DNA, 813 bp, Homo sapiens
  misc_feature: GYAE6OF01BD5FM.10.35.D02.1.454.CMB.1.raw
  modified_base (184)..(184): a, c, t, g, unknown or other
  misc_feature (184)..(184): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccagtggagtttgggctggaggtggtattttcctgctgactaattttaaaggngtccagtgtgacgtgcgtagttggtggagtcggtgggggagtcgttagggttaacgggccggggggttccttaggaccttcgtccgttgttccacgtcctcgtaggattcgagttcgtacacgtaacgccgtaggatgagtcgtcggtccgccgaccggtcccggaggggacgggcgtgggaggttgggttcggtaccgtttaagtaacgaacgctaacggtaccgtaggacggttagggtacggaaactaaacggagtaacgggttaccggacgttaaggtaacggtttaaacggaaaacggtccgtaaggttaacgttccggaacctacttacgtaacgtaatttggaacttaaggaacgttaacgaaaaccgtaacgtaaccggttaagttactaacggtaaggaaacttcggaacgtacggtaacggtaccgtaaggggtaaaaccgacgttaacgtaacgaaaccgtaccggaacgggttaccttaacttaaacggtttacttaaacccggtaaaccgtaaaccggttaaacgtaacccggttaacccccgaaaaggtaaacgttacgggttaaccggggaaaggggtaaccgtacggttaccggggtaaccgggtaccggggg

SEQ ID NO: 176840 - DNA, 666 bp, Homo sapiens
  misc_feature: GYAE6OF01DA1Q5.10.35.D02.1.454.CMB.1.raw
  modified_base (320)..(320): a, c, t, g, unknown or other
  misc_feature (320)..(320): n is a, c, g, or t
  modified_base (403)..(403): a, c, t, g, unknown or other
  misc_feature (403)..(403): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctgaggtggtattttcctgctgctaattttaaaaggtgtccagtgtgacgtgctagttggtggagtcggtgggggaggtcgttagggttaacggccggggggttcccttagacctctccgtgttcacgcctcgtggattcagtgtccactaaccgcctggatgagtcgtgggtccnccgacgtccccgaggggacgggcgtggaggtgggttgtcttagtagagcagtacctgagtggtaggaacaacgaggagtacgngtaggtaacgttacggtaaaaggctaagtacgttccgactatcctactaattgatagagtaacaaagtaccgtacgtagtactacgtagtaaacgtggacgtacgacgaccgtaaggaaacgtacgagtacgaaccgaacgtacggtaacttacgtttagttaactttaccgtaaaccgtaaccgttaaacggtaccgtaaccccgaaacgtaaacggtacgttagggtaacgggaagggtcgtcgggtcgggtaaccggggg

SEQ ID NO: 176841 - DNA, 707 bp, Homo sapiens
  misc_feature: GYAE6OF01EF6TE.10.35.D02.1.454.CMB.1.raw
  modified_base (320)..(320): a, c, t, g, unknown or other
  misc_feature (320)..(320): n is a, c, g, or t
  modified_base (376)..(376): a, c, t, g, unknown or other
  misc_feature (376)..(376): n is a, c, g, or t
tcagcatagtagtgcacgaccggtgctcgatttagcacacgataggttgggtttggggctgggagaggagccccagccctgggattcccaagtgtcttcattcagtgatcaggactgaacacagaggactcaccatggagtttgggctgaggtggatttttccttgctgcaattttaaaaggtgtccagtgtgacgtgcagttggtggagtcgtgggggagtcgttgggttaaggccgggggggttcccttagacctcgtccgtgttcagtccttctggtacttcgagtcgtacactaacgcctggatgacgctggtccnccagtcccgagggacgggctggagtgggttgccttagtagagcagacctgagtggnggaacaacgagacgtacgcgtggtattacgtaaaggctaagtacgttaccgacctatacgttacgtaagttcgaattacggaaagtaacgaaaacggaaaccgtaaccggtttacgtaaacgttaccgttaaggtaaaatcgggaaacgtaccgtaaggtcccgttaaaggggaaacggtccgtaaagttacggaaccgtaacgtaacggtaccttacgttaaagtttagttaccgttaaacccgtaacttaaacggtaccgtaaccccgtaaacggtaaacgaacccgttacggggtaagggaacgggtacgtgggaccggtaccggggg

SEQ ID NO: 176842 - DNA, 720 bp, Homo sapiens
  misc_feature: GYAE6OF01C2989.10.35.D02.1.454.CMB.1.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctggaggtggtattttcctgctgactaagttttaaaaggtgtccagtgtgacgtgcgtaggttggnggagtcggngggggagtcgttgggttaacggccggggggtccttagacctctcctgttcagcctctggattcgagtgtccactaaccgcctggatgacgcgtcgggtccgccgtacggtccccgaaggggaacggggtcctgggaaggttcggggtttaggtcccgttttaagttaaggaacgtcgaacggtaccgtggagttcgggtaacgggaacctaaacggaggtaagtaccggacgtaggtaacgtttaacggaaaaggcaaggtacttccgacctatctacctaagttgatagtaacgtaacaaaacgtaaccgtaccgttagtaactagtaacggtaaagtgaacgtaccacggtacccgtaagggaaacgcgtaagtacgaacaacgtaggacttacgttaacttgttaccgtaaaccgtaacgtaaacgttaaccggtacccgtaaaggaaaccgtaggtacgggtaaacggggaggtaccgtggtccgggtaaccggggg

SEQ ID NO: 176843 - DNA, 670 bp, Homo sapiens
  misc_feature: GYAE6OF01CBHAW.10.35.D02.1.454.CMB.1.raw
  modified_base (221)..(221): a, c, t, g, unknown or other
  misc_feature (221)..(221): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaaggtgtccagtgtgacgtgcagttggtggagtcgtgggggagngttggttaaggccggggggtccttagactctcctgttcagcctctggattcagtgtacacctaacgccgtaggatgacgcgtggtccccgcacgtccccggaggggaacggggtctgggagttcggggttggccttaagttagagtcagtaccgtgagtggtgggaactaacgagtacgtacgagtcggtattacggtaaaaggctagaattcgctatctataatagntagaacgtanaaanaactaccgtagtactacgtaggaaatgacgcgagaccgtaggaaacgccgtagtacgaacgaacgtacgtaacgttacttaaatttaccgttaggttaaccctaaacggttaaaccgtaccggttaacccccgaaacggtaacgggtaacccgtagggggtaacggggttaaacggggaccttggggtaccgggttaacccgggggg

SEQ ID NO: 176844 - DNA, 808 bp, Homo sapiens
  misc_feature: GYAE6OF01CNHBN.10.35.D02.1.454.CMB.1.raw
  modified_base (181)..(181): a, c, t, g, unknown or other
  misc_feature (181)..(181): n is a, c, g, or t
  modified_base (480)..(480): a, c, t, g, unknown or other
  misc_feature (480)..(480): n is a, c, g, or t
tcagcatagtagtgcacgaccggtgctcgatttagcacacgatagttgggtttgggggggagaggagccccagccctgggattcccaagtgtcttcattcagtgatcaggactgaacacagaggactcaccatggagtttgggctgaggtggtattttccttgctgctaaattttaaaggngtccagtgtgacgtgctaggttggtggaggtcggtggggggaggtcgtttaggggttaacggggcccgggggggttcccttaaggtaccgttccgttcccgttcggttccacggtcccgttcgtacgggtattcgaagttcgtacctaacgtaaccgccgtgggatggacgtcggtacgggtcccgccgacggtccccggaagggggaacggggcgtaggagggttggttacggtaccgtttaagttaagaacgcgacgtacctggagtcgggtaaggacaacgtaaggtacgtacggngttaggtaagttaaccggtaaaagggctaagtacgttccgactaactccgtactaaggttgaacgtaggtaacgtaacgaaacgtaacgttaacgttggttaactaggtaaacgggtaaatacgaacggttaacgacggtaagtacgggaaaacgcgtaagtaaccggactaaccggtaacggtaactttacttaaacgtttaagttaacccggtaacctaaaccggtaaaggtaacccgtacccggaaaacgttaacgggaacggttaggggtaaacggggtagggtacccggtaggtccgggtaccgggggtaacccgaacggggg

SEQ ID NO: 176845 - DNA, 692 bp, Homo sapiens
  misc_feature: GYAE6OF01BNSJI.10.35.D02.1.454.CMB.1.raw
  modified_base (399)..(399): a, c, t, g, unknown or other
  misc_feature (399)..(399): n is a, c, g, or t
  modified_base (685)..(685): a, c, t, g, unknown or other
  misc_feature (685)..(685): n is a, c, g, or t
tcagcatagtagtgcacgaccggtgctcgatttagcacacgataggttgggtttggggggtcccttagactctcctgttcagcctctggattcagtgtcactaacgcctggatgagctgggtccgccagtccccagggaagggctggacgtgggttgccttattagaagcagacctgagtggtgggacaacagagtacgcgtggattacgtaaaaggcagacttcgccatctacaattgatgagtacaaagacaccgtgtatctagtaaatgagcagcctaggaagcgatagacacgaggactctattattcgtaccagtaagacgtacccaacgtaagactggtagggaaggctgcgtgggccagggacgtccttgcctaccgtctccctgcgtcccnccaaccgaacgggtccctaagttccccggttacccttcccccgtggacccgtcccgttcggaccctaccgacgggacctcccgtacccgtacccgtaacgaccgaccgtaccgaccgggccgggtcccgtacggggtacctcgggtacccgttacggtacccgtaacggtacccctttaacccttccccgtaaacgtttacccgtaacgttaccggtccggttaggaccgggtcccgggggttacctccggggtaaacgaccggggaccgaacggtaagttacggngtaaccg

SEQ ID NO: 176846 - DNA, 787 bp, Homo sapiens
  misc_feature: GYAE6OF01BJ5FI.10.35.D02.1.454.CMB.1.raw
  modified_base (572)..(572): a, c, t, g, unknown or other
  misc_feature (572)..(572): n is a, c, g, or t
  modified_base (611)..(611): a, c, t, g, unknown or other
  misc_feature (611)..(611): n is a, c, g, or t
tcagcatagtagtgcacgaccggtgctcgatttagcacacgatagttgggtttggggagctctgggagaggacgccccagccctggacttcccaagtgtcttcattcagtgatcagactgaacacagaggactcgaccagtgggtagtttgggcttggaggttggtactttttccgttgtctgtacttaaagtttttaaaggcgtaccaggttgtagacgtgacgtaggttcgggtgggtaggttcggtggggggtacggtcggtttacggggtaaccggggtcccggggggttacccttaggtaccttccgttccgttacggttccgacgtcccgttcgtacggtactttacgtagttcgtaccgtaacgtaaccgtccgtaggtacgtacggtacggtccggtccgggtacccgaccgtaccggtacccgggaggggtacgggtcggtgggtagggttcgggttacgtacgtttagtaaggacgtcgaacgcgtacggagtacgggtacgaacgtacgtaggacgtagtcgtagtacgttaaggaaagtctagtacgtcacctagtactntaacgtgtacacgtaagtaaacgaacgtaccttacggtntaacgtagtaacggtaacgttacgaacgtcgaacgtacggtaacggtaacgcgttaagaccgacgtaacaccggttaattaccgtaagttaccgttagtaaaccgtaacgttaacgaacccgtaacccgaaggtaaccgttagggtaacggggtagggtaaccgtcgggtaacggg

SEQ ID NO: 176847 - DNA, 909 bp, Homo sapiens
  misc_feature: GYAE6OF01B359P.10.35.D02.1.454.CMB.1.raw
  modified_base (199)..(199): a, c, t, g, unknown or other
  misc_feature (199)..(199): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctgaggtgtattttcctgctgactaattttaaaggtgtacctagtgtagacgtgntaggttggtggagtcggtgggggaggtcgttaggggttaacgggtcccgggggggttacccttaacggtaccgttccgttccgttcgttaccgtacggtcccgttcgttgggtactttccgtaagttcgttacctaaaccgtaaccggtcccggttagggtaagttcggaacggttcggttaccgggggttaccccggaccccgtaccgggtacccccggggaaaggggggtaaccgggggtcgttagggggtacgggtttcgggggtttacggttacccgtttaaggtttaacgggaaacggtacgtaaccgggtaaccgtaggtacggttacggggttaacgggaaaacccgtaaacggtaacgggaacggtttaccggtacggtacgggttaacgttaaacggggtaaaaagggcctaacgggtaaacttcccggaacccgttacgttacgttaacgttaagtttacggaaacgttacggaaacggttaaccgaaaacggtaaaccgttaccgggttattaacgttaacgtaaggaaacgtacggaagaacgacgaccggtaagggtaaacgacgtaacgagtaacgaaccgtaaggtacccttagttaacgttacctaaccggtaacctaaacggttaaacgaaccgtacccgaaagtacggtacggtaagggtacggggaaaggcgtcgggtagggtaccggggg

SEQ ID NO: 176848 - DNA, 703 bp, Homo sapiens
  misc_feature: GYAE6OF01CQ2E2.10.35.D02.1.454.CMB.1.raw
  modified_base (285)..(285): a, c, t, g, unknown or other
  misc_feature (285)..(285): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttccttgctgctaattttaaaaggtgtccagtgtgacgtgctagttggtggagtcgtgggggagtcgttgggttaacggccggggggtcccttagacttctcctgttcagtcctcgtggattcagtntcactaacgcctggatgagtcgtcgggtcgccgacgtccccgagggaacggggcctggagtgggttggccttattagaagcgagacctgatagggtggaactaagagagtacgcgtaggtaacgttacgaaaaggctaaggtacttaccgcgtacttacctacttaacgttagtaatcggtaaagttaacgaaaacgtaaccaaccgggtttagttaacgtaccgtaagggtaaattgggaaacgtaccgaaggtacccgttaaaggggaaacggaaccgtagttaacggaacctaacggacggtaaccttcgttaaattacgttacgttaaccaaacgttaaccgaacggttcccgaaaccggtaagtaaccgtaggggtaacgggggaaaggtcgtaggggtcggtaaccgggggg

SEQ ID NO: 176849 - DNA, 801 bp, Homo sapiens
  misc_feature: GYAE6OF01CIPPG.10.35.D02.1.454.CMB.1.raw
  modified_base (798)..(798): a, c, t, g, unknown or other
  misc_feature (798)..(798): n is a, c, g, or t
tcagcatagtagtgcacgaccggtgctcgatttagcacacgatagttgggtttgggggggtcccttagactctcctgttcagcctctggattcagtgtcactaacgcctggatgagcgtgggtcccgccacgtccccgaggggaagggcgtgggaggttgggttggtaccttaagttaggaagcagacctggagtgggtagggaacaacgaaggagtacgcgtaggtaagttaaccggtaaaaaggcaggtacttccggacctatctactaattgagtagagtacaaagaactcgtagtactacgtagaatgacgacgtacgacgtaggaaacgcgtaacgtacgaacctacgaacggtacttacttaattacgttacgtaacctaagtaacgaccgtaccaacgaacgtagtagggtaacgggaacggtacgtacgggtcggtacggggacccggaaggggtacccgtcccgttacggtaccctaacccggttctcccgttaccgacccggttccccgtaacccggaccggaaccggtaccccgtcgttaccccggttacccgtcccccggtacgtcccggtcccgtacgtccgtaccgacggtaccgcccgtaacccggaccgaccggaccgtcccgaacggacccgggcccgggtccggaccggtccgtacccgggtacggttaccggtaacgtaaccggtaacccgttacccgtaacccgtacttaccgttacggtaccgtcggtacgggacggtccgggcgtaacggtaccggacggaccctaggacctaggntcg

SEQ ID NO: 176850 - DNA, 824 bp, Homo sapiens
  misc_feature: GYAE6OF01AGEP4.10.35.D02.1.454.CMB.1.raw
  modified_base (214)..(214): a, c, t, g, unknown or other
  misc_feature (214)..(214): n is a, c, g, or t
  modified_base (283)..(283): a, c, t, g, unknown or other
  misc_feature (283)..(283): n is a, c, g, or t
tcagcatagtagtgcacgaccggtgctcgatttagcacacgatagttgggtttgggctgggagaggacgccccagccctgggacttcccaagtgtcttcattcagtgatcaggactgaacacagagactcaccatggagtttgggctgaggtggtattttccttgctgactaaagttttaaaaggtgtccagtgtgacgtgctaggttggtggngtcggtagggggaggtcgtttagggttaacgggtcccggggggttcccttagacctccgtccttgttcncgtcctcgttggtacttcgtagtcgtccacctaacgtcccgtggactgacgtccgttcgggtccccgacccggaccggtaccccggaagggggacggggtcgtaggggtacgggttgggtttccggtaccttttaagttaacggaacggtacgaaacggtaccttggtacggtcgggtacggaaccgaaacgaacggtaacggtacggtacggttaaggtaaaccggtttaaaggaaaacggtctaacggttaacgttcccgaaccttaccttacctaaagtagtttagtagtaaacccgttaagaaacgaaacggttaaacccgtaacgtttacggtaaacgttacggtaaggtaagtagacccgaacgtaccgtaacggaaggtaacgaccgtaagtaccacggtaacccgaagttacctaagttactaacgtttaccggtaaacctaacggtaaccgtaacccgtaaccggaaacgtaacgggttaaccggtaggggtacgggaaaggtcgttaaccgggccggggttaaacccgggg

SEQ ID NO: 176851 - DNA, 705 bp, Homo sapiens
  misc_feature: GYAE6OF01ELNM0.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaatttttaaaaggtgtccagtgtgacgtgcagttggtggagtcgtgggggaggcttagggttaaggccggggggtcccttagactctcctgttcagtccttcgtggtattcgagtcgtacactaacgccgtggatgagccgtgggtcccgccacgtccccggaggggaacggggtccgtgggtaggtggggtttcggtccgtttaagttagaacggctaacgaccgtgacgtggtaggacaacgaggacgtacggcgtaggaacgtttacggaaaaggcaaaggtacttcgaccgtattcctactaagttgagtagagtaacgaaacgaaccgtaccgttagttaacgtcgtaaggaagtacgaacgcgaacggtaccgtaagggaacgacgtacgtacgaacgaacggtagtaccttaacgttacgtttaaacttacggtaaccctaaacgttaaacggacccgttaaccccgaaacggtaaaggtaacccgttagggtaacggggaacggtacggtagggccggtaaccgggggg

SEQ ID NO: 176852 - DNA, 660 bp, Homo sapiens
  misc_feature: GYAE6OF01C1MF7.10.35.D02.1.454.CMB.1.raw
  modified_base (373)..(373): a, c, t, g, unknown or other
  misc_feature (373)..(373): n is a, c, g, or t
  modified_base (542)..(542): a, c, t, g, unknown or other
  misc_feature (542)..(542): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttcccttgctgactaattttaaaagtgtccagtgtgacgtgcaggttggtggagtcgtgggggaggtcgttaggttaacggccggggggttcccttagacctcgtccgtgttcagcctctcggattcagtctcactaacgctggatgagccgtggtcccgccacggtccccgagggacgggcgtggaggtgggttggccttagtagagcacgtcngtagtgggtacgaacaacgagtaagtacgtcgtaggtaagttacgtaaaggactagtacgtcgacctagtctacgtaattgaacttagactaacgaaaacgtaccgtaaccgttgtacgttacgtaaggtaagtggaagtacgacgtaccgtaagggaacgtacggtanagaccgaagtccgtacgttaccttaagttaactttccggaaactacgtaaacgtacccgtaacccgaacggtaaacgtacgtaggggttaggaacgggtacgtggtgggtacccgggg

SEQ ID NO: 176853 - DNA, 1092 bp, Homo sapiens
  misc_feature: GYAE6OF01D2G4Q.10.35.D02.1.454.CMB.1.raw
tcagcatagtagtgcacgaccggtgctcgatttagcacacgatagttggggtttggggctgggagaggacgccccagccctgggacttcccaagtgtcttcattcagtgatcaggactgaacacagaggactcaccagtggtaggtttgggctggaggtggtacttttccgtgctgtactaaagttttaaaaggtgtccgtaggtgtggacgtgtcgtaggttgggtggtacggtgggtgggggtacggtcggttttacggggttaaccgggggtcccgggggggttacccctttaacgggtacctttcccgttcccgtttacggttccgtaccggtcccgtttcgtacgggttactttaccgtacggtttacggtaccgtaaacccggtttaaacccggccccggttaaggggtaaccgttaagggtaccggttaccgggtttacccggggggttcccccggtaccccggtaaaccccgggtttaccccccccggggaaaggggggggtaaaccggggggtcccggtttaggggggtaaccggggttttcgggggttttaccgggttaaacccgttttaaaggttttaaacgggaaacggttacccggtaaacgggttacccgtagggtaaggttcggggtaacgggaaacctaaacggtacgggtaacggttaccggtaacgttacgggttaaacgtttaaaccgggaaaaaacgggtcgtaaacggtttaaccgtttacccgggaacccttaacgttaccgttaacggtaaaccgttaggtaaacgtaggtaaaccgtaaaccggtaaaaagtaaccccgtttacggtaacggtttaacgtaccgggtaaaggtaaacttacgggaagtacccggtaacgtaccggttaaagggaaaccggtacggtaacttaacggaacccgtaacggtacggttaaaccctttcgtttaaagtttaaaccgtaacccggttaaaccgtaaacccggttaagggaaacccccgtttacccggaaaacggtaaacgtaccggttaacgggggtaacggggaaaccgggtttacgtacggggcccgggtaacccgggggg

SEQ ID NO: 176854 - DNA, 605 bp, Homo sapiens
  misc_feature: GYAE6OF01AZ8SX.10.35.D02.1.454.CMB.1.raw
  modified_base (370)..(370): a, c, t, g, unknown or other
  misc_feature (370)..(370): n is a, c, g, or t
  modified_base (503)..(503): a, c, t, g, unknown or other
  misc_feature (503)..(503): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (555)..(555): a, c, t, g, unknown or other
  misc_feature (555)..(555): n is a, c, g, or t
  modified_base (557)..(558): a, c, t, g, unknown or other
  misc_feature (557)..(558): n is a, c, g, or t
  modified_base (560)..(560): a, c, t, g, unknown or other
  misc_feature (560)..(560): n is a, c, g, or t
  modified_base (569)..(569): a, c, t, g, unknown or other
  misc_feature (569)..(569): n is a, c, g, or t
  modified_base (580)..(581): a, c, t, g, unknown or other
  misc_feature (580)..(581): n is a, c, g, or t
  modified_base (588)..(588): a, c, t, g, unknown or other
  misc_feature (588)..(588): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
tcagcatagtagtgcacgaccggtgctcgatttagcacacgatagttgggttggccttattagaagcagacctgatggtggacaacagagtacgctggattcgtaaaaggcagattcgccatctcaattgatgagtcaaagaacaccgtgtatctaggaaatgagcagcctaggaaagcgatgacacaggactctagttattgaccactaagcgtcccaagaagactggtgggaaggacctgcgtgggggccagggacgtcccgttgtccgacccgtctcccttcgacgccccttccgaacccgaacggggcccctaacgttcccggtccctttcccccgtggcccgtccccgtcgcctccggacgggcncccgtaccgtcccgagacgaccgtacaggccccgtcccgtggggcctacggccgttacgggacctaaccggtacctttacccgttccccaacttacgtacgtcgtaccgtggaccggcgggtcgtacccgggngtaaaccgggcgaaccgtaagtacggctggatacgatgccggatangnncgngnngngcgtcgtcncgcgcgtcgtnncgtcgcngcgcacgcncngcgacg

SEQ ID NO: 176855 - DNA, 742 bp, Homo sapiens
  misc_feature: GYAE6OF01B3I0T.10.35.D02.1.454.CMB.1.raw
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
tcagcatagtagtgcacgaccggtgctcgatttagcacacgataggttgggtttggggagctcgtgggagagtagccccagccctgggattcccaagtgtcttcattcagtgatcaggactgaacacagaggactcaccagtggtagttgggctggaggtggtattttccttgctgactaaagtttaaaaggtcgtacctagtgtgacgtgtcgtaggttggtggtagtcggtgggggtagtcgttagggtaacgggtccggggggttaccttagcgtccgtccgtgtcacgcctcgtggtatcagtntcaacgtacgcgtgatgngtcgtcggccnccgcggtcccgagggtaggcgtggtaggtgggtcgtacttagtagacgcgacgtccgtggagtgggtacggaactaagagtacggtacgcgtaggtaacgttaacggtaaaacggcgtacgtaacgttcccggaccttaacgtaccttacgtaaagttagtacgtaaacgggtaacgtaaacggaaaaccgttaaccgtaccggttaaaggttaccgttaacggtaaaggtacgtaacgggaacgtaccggaaccggtaacccggaagggtaaagaaccggtactaacggacctaaacgacggttaactaccgtttaagttacttaacccgaactaacccggttaaacgaccgttaacccgaaaccgtacggttacgaacgggtacgggaagggtcgtaacgggg

SEQ ID NO: 176856 - DNA, 947 bp, Homo sapiens
  misc_feature: GYAE6OF01A7Z2W.10.35.D02.1.454.CMB.1.raw
tcagcatagtagtgcacgaccggtgctcgatttagcacacgataggttgggtttgggctgggagaggacgccccagcccgtgggacttcccaagtgtcttcattcagtgatcgaggactgaacacgaggagactcaccagtggtagtttgggctggaggtggtattttcctggctgactaaagttttaaaggtcgtcgagtgtgacgtgacgtggttggtggtacggtgtagggaggggacgttcgttacgggttaacggggtccccggggggttaccctttaaggtcccgttccgttccgttacggtttaccgacccggtccgtttacggttacggtactttaccgtacggttaccggtaccgttaaccgttaaccggtcccggtaggtaagtcggtaccggtccggttccgggtacccccgtaacccggtaccggttacccccggggaaagggggttaacggggtcgtaggggtacgggttcggggttacggtaaccgtttaagtaacggaacgtcgtaacggtccggtagtacggtacgggtaacggaacgtaaggacggtaacgttcggacggttaggtaaacgtacgggtaaagtacgacggttacctaccggaacctacggttacgttaacctaagggttccgtagtaacgtaaacgtacgtaaaccgggtaaccttaaccggtagtaaacggttacggtaaacgtaaggtcgttaacggaacgtccgggtaaacgtaaccgggaagtaccggtaaccgttaacgaaacggttaccgtaaccggttaacctttaaaccgtttgttaaaacccgttacccgggtaaacgttaacccgggaccggtttaaacccgaacgggttacccggttaaacgggttaaccggggtaacggttaaaccgggggacccgttaacggggtttacccccgggaaaccgggggg

SEQ ID NO: 176857 - DNA, 769 bp, Homo sapiens
  misc_feature: GYAE6OF01BNV4J.10.35.D02.1.454.CMB.1.raw
  modified_base (182)..(182): a, c, t, g, unknown or other
  misc_feature (182)..(182): n is a, c, g, or t
  modified_base (755)..(755): a, c, t, g, unknown or other
  misc_feature (755)..(755): n is a, c, g, or t
tcagcatagtagtgcacgaccggtgctcgatttagcacacgatagttgggtttggggctgggagaggagccccagccctgggattcccaagtgtcttcattcagtgatcaggactagaacacagaggactcaccatggaggttgggctggaggtggtatttcctgctgactaatttaaaggntccagtgtgacgtgctaggttggtggagtcggtggggacggtcgttagggtaacgggccgggggtcctaagctcgtctggtcagtcccgtgtaggtattacgtagtcgtaccaacgttaaccgccgtaggagtacggacggtccgtacggggtccgaccgtaccggtacccggaagggggtaacgggccgtaggggtaagggttcgggttacggtaacgtttaagtaacggaacggtcctaacggacgtaggtaccggtagggaacggaaacctaaaggtaggtaccgtaacggtacggttaaggtaacggttaaacggtaaaggtaccaagtaccgtaccggactacggtaacttacaaggttgaaacgtaggtaaacgtaacgtaaaaccgtaacgtaaccgttaaggttaacgtaacgtaaggtaaagtcgaacgacgttaacggaccggtaaaggaacgtaccgtaagtaaccgaacgaacggtataaccttagttattaaccgtacgtaaaccgaggttaacccacgtaacccgaagtaacgtacggttacggaaggggaactacggnggccggtaaccggg

SEQ ID NO: 176858 - DNA, 949 bp, Homo sapiens
  misc_feature: GYAE6OF01CUZ4Q.10.35.D02.1.454.CMB.1.raw
  modified_base (737)..(737): a, c, t, g, unknown or other
  misc_feature (737)..(737): n is a, c, g, or t
tcagcatagtagtgcacgaccggtgctcgatttagcacacgatagttgggtttgggctgggagaggagccccagccctgggattcccaagtgtcttcattcagtgatcaggactgaacacagaggactcaccatggagttggctgaggtgtatttcctgctgactaatttaaagtgtcagtgtgacgtgcagttggtggagtcggtaggggaggtcgttagggttaacgggtcccgggggggttaccctttaggaccgttccgttccgttaggtttccgacgtcccgttacgtggttaacttcgtaggtcgtactaaccgtaaccgtccgttagggagttaggacggtccgttcggggtaccccgtacccgtacccgggtaccccgaaggggtacgggttaccgtaggggaacgggtttcggggttacccggtacctttaaggttaaacggaagtccgtaacggtacccgtaggtacggttacgggtaacgggaacctaaaccggtaagtaaccggtacgtaccggtaggttaaccgttaacgggtaaaacgacgttagttaaccgttccgtaaccgacgttaccgtaacgtaacgtttcggaacttaacggtaaacggtaaccggtaaaaacggtaaacccgttaaccggttaaggttaaccgttaacgggtaaacgtaaccggttaagggaaccggtaaccggttaacggaaacccggttaaaacccggggtaanaacccggggttaaacgtaccgggaaaccgtaaacccggtaacgggtaaccttttaacggttaaccgtttaaacgttaacccgttaaaacccgttcgggtttaaaacccgtaaccggtaccccccgggttaaagtaaaaccgggtcccgggttaaaaggggacccgggttaaagggggacccgttaaccggggtcgggttaaaccccgggggg

SEQ ID NO: 176859 - DNA, 701 bp, Homo sapiens
  misc_feature: GYAE6OF01BD7DX.10.35.D02.1.454.CMB.1.raw
  modified_base (168)..(168): a, c, t, g, unknown or other
  misc_feature (168)..(168): n is a, c, g, or t
  modified_base (381)..(381): a, c, t, g, unknown or other
  misc_feature (381)..(381): n is a, c, g, or t
  modified_base (588)..(588): a, c, t, g, unknown or other
  misc_feature (588)..(588): n is a, c, g, or t
  modified_base (692)..(692): a, c, t, g, unknown or other
  misc_feature (692)..(692): n is a, c, g, or t
tcagcatagtagtgcacgaccggtgctcgatttagcacacgatagttgggtttggggctgggagaggagccccagccctgggattcccaagtgtcttcattcagtgatcaggactagaacacagaggactcaccatggagtttggctgaggtggtattttcctgctgntaaattttaaaggtgtcagtgtgacgtgcgtagttggtggagtcggtgggggaggtcgttagggttaacgggtccggggggttacccttagaccttcctcccgttgttacgacgtccgttcgtagtacttcgagttcgtactaaccgtacgtccgtagtactagacggtccggtcggtccccaccgtaccggaccgggaggggtacgggtcgngggttaggttgggttacgtaccttaagtacgaagtaccagtcgtaggtaggtaggacgaacgaacgaggtacgtaccgtggtaacggtaacgtttaaacggaaagtacgtaagtaccgtcaccgtattacctaatacgtagtataacgagtaacaaacgtacctcgtagtactcgtaagatacgacgacgaggtacgaaggaaccgntaaactacgagaaccgtacgtaatactttaagtactaacgtaacctaaagtacccgtacgtaaccgaacgtagtacgggtagggtagggaacgtcgtaacgggnggtaccggg

SEQ ID NO: 176860 - DNA, 712 bp, Homo sapiens
  misc_feature: GYAE6OF01CLA7K.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctgaggtggattttcctgctgactaattttaaaaggtgtccagtgtgacgtgctagttggtggagtcgtgggggaggtcgtttagggttaaaggcccggggggtaccctttaggaccttccgttcccgttgttcacgtcctcgtggtattcgagttcgtaccactaacgccgtaggactgacgtcgttcgggtcccgccgacggtaccccgaggggacgggtcgtgggtaggttggggttcggtacctttaggtttaaggaacggtcgtaacggaccgtagaggttacggacgggaacaacgtacggacggtacgcgtaggtagttacggtaaaaacggcgtaagtacgttaccgctaacttctaacgtaagttagtaagtagtaacgtaacgaaaacgtaaccgtaaccgttacgtaagtacgtaaggtaagtacgaacgtacgtacgaccgtaggaacgacgagtacgaacacgacggtactacttagttacttagtaacctacgtaaagaccgttacccaacgtaacgtacgtagggtacgggaaaggtcgtggccggtacgggg

SEQ ID NO: 176861 - DNA, 980 bp, Homo sapiens
  misc_feature: GYAE6OF01ASTY0.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccagtggtagtttgggctaggaggttgttacttttcctgtctagtaacttaaagttttaaaggtcgtaccgtaggtcggtacggtacggtcgagttagggttgggtagggtacggttacggggtagggggtacggttacgggttttaacgggggttaaacccggggggttccccgggggggtttaacccctttaacgggtacccgtttcccgtttaccgtttccggttaccggtaccgttcccggttccggttaggttacgtttacggtcgttaccggtaacctaacccgtaaccgtccgggttagtacggtacggtaaccggttccggtacccggggtaccccgacccgtacccgggggtaaccccgggaagggggtaccggggttacggtacggggttacggggttcgggtttaccggttaaccgtttaaggtacgtaacgtaccggtacgtaccggtggtaggtacgggaaccgggtaaactaggtaaccggagtacggtcgtaaggtaaacggttacggaaagtcgtaacgtcggtaccgtacgtacttacgtaactaggttaagcgttaagtaacgaacgtaaacggtaacccgtacggtttacgttacggtaggtaaagttaccgtaaggtaccgtaccgtaaaccgtaccgggttaaggaacggttaccccgttaagaaacccggtacgaaccggttacgttaaccttaccggttaagttaccccgttaagggtaacccctaaacgggtaacggtaacccccttaccggaaaaccgtttaaagggtcccggttaaagggaacgggttaacccgttcggaaccgggtccgggtaaacccgggg

SEQ ID NO: 176862 - DNA, 847 bp, Homo sapiens
  misc_feature: GYAE6OF01DYD6Z.10.35.D02.1.454.CMB.1.raw
  modified_base (260)..(260): a, c, t, g, unknown or other
  misc_feature (260)..(260): n is a, c, g, or t
tcagcatagtagtgcacgaccggtgctcgatttagcacacgatagttgggttggggctggagaggagcccagccctgggattcccaagtgtcttcattcagtgatcgaggactagaacacagaggactcaccagtggtagtttgggactggaggttggttacttttccgtgtctagtacttaaagtttttaaaaggtcgttccgtaaggtgttacggacgtagtcgtaggttcggtagggtaggtccggggtaggggggnggttaccggtttagggttaaccggggtcccgggggggttacccttacggtacccttcgttcccgttcggtacgacgtcccgttagtggtattaccgtgtacgtacctaaacgttaccgccggttaggatcgacggtcgtacggtaccccgcgtaaccgcccgggaagggggtacggggtcgttggggaccggttttcgggtacggttaccgtttaagaacgggacgtacggtaacgacgttaggacgggtaacgggtcggaaacaaaccggtaggtaccgttagtaccggtaaaggtttaacaacggggaaacgtagtaacttaccgtacggtctaacgttaccacttaagttgaagttacgtaacgtaacgaaaccgtaaccggtactaggttacacggtaaggaactaggactacgggctaagggacgaaacggcgtagtaaccgaccgtaaacgtacggtaacctttaaggtacttttaaccgtaagtaaccccgaaaaggtttaaacccaccggtaaacccgaaacggtaacgtacggttacggggaacggaaaggttcccggtaggaacgggtccccggggg

SEQ ID NO: 176863 - DNA, 715 bp, Homo sapiens
  misc_feature: GYAE6OF01E3KFK.10.35.D02.1.454.CMB.1.raw
  modified_base (279)..(279): a, c, t, g, unknown or other
  misc_feature (279)..(279): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctgaggtggattttcctgctgctaattttaaaaggtgtccagtgtgacgtgcagttggtggagtcgtgggggagtcgttgggttaacggcccggggggttcctagacctctcctgttcagcctctgtattcagtntcactaacgccgtggatgagtcgtcgggtccgccgacggtccccgagggacggggtcgtagggagggttggggttcggtccgtttaagttacgaacgtacgagacccgtgtacggtgggtacggaacaaacgaggtacggtacggcgttagggtaacttaaacgggtaaaacggtcgacggtacttccggacctagtacctactaagttgagttacgaacgtaacgaaacgtaaccgaaccgtgttactacgtaacggtaagtagacgtacgacgaccggtaaggaaacgtcgtaacgttagaaccgacgtaccggaaccttacgtaacgtttaactaccggttaacccgtaacgttaaccgtaacccgtacccgtaacggaaacggtacggtacgggttaacggggaacgggtcgttacgggcgggtaccggggg

SEQ ID NO: 176864 - DNA, 537 bp, Homo sapiens
  misc_feature: GYAE6OF01CLGV6.10.35.D02.1.454.CMB.1.raw
  modified_base (178)..(178): a, c, t, g, unknown or other
  misc_feature (178)..(178): n is a, c, g, or t
  modified_base (259)..(259): a, c, t, g, unknown or other
  misc_feature (259)..(259): n is a, c, g, or t
  modified_base (322)..(322): a, c, t, g, unknown or other
  misc_feature (322)..(322): n is a, c, g, or t
  modified_base (393)..(393): a, c, t, g, unknown or other
  misc_feature (393)..(393): n is a, c, g, or t
  modified_base (504)..(537): a, c, t, g, unknown or other
  misc_feature (504)..(537): n is a, c, g, or t
tcagcatagtagtgcacgaccggtgctcgatttagcacacgatagttgggttggccttattagaagcagacctgatggtgggacaacagagtacgctggattcgtaaaaggcagattcgccatctcaattgatgagtcaaaagaacaccgtgtatctggaaatgagcagcctggaaancgatgacacgaggactctattatgtaaccactaagacgtcccaagaagactggtggggaaggctgcgtggggccagggacncccttgtccaccgtctcctcacgccctccaccgaacgggccccagtccgggtccttcccccgnggccgtcccctgccctcgaggcgccacctcgacgacgccacgcggcccggtcccgtcgggcctcggtccgnggtaccgaaacgggtaccctaccctttcccccaacttcgttaacgtcggtaccgtcgggagggcccggggtacgtacgggacccggaagggtaccaccgtaagagctgcgnnnnnnnnnnnnnnnnnnnnnnnnnnnnnnnnnn

SEQ ID NO: 176865 - DNA, 747 bp, Homo sapiens
  misc_feature: GYAE6OF01C6AFP.10.35.D02.1.454.CMB.1.raw
  modified_base (216)..(216): a, c, t, g, unknown or other
  misc_feature (216)..(216): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctcggcctcccaacgaaccaccggagaagttgtgttgacgtcagtctccgacggcctacccttggttctttgtcctaccgaaggggtaaancgccctacccttctcctgccgacgggccctagtcctaacgttagttcggttaacggtactaacctaaacgttacgttacgtccgttagggttcgacaacgtacctaaccgtaaaacccggttcgggaccctaaccggtccctaccccggtaaggtcccttcctactacttcgttagtcggaccttagacctactacccgatccgggacggtaccctacgtcgacctcgtacccgagactagtcttcgacggttacgcggttacgggttcgggtacgacggtacagttacctctaccgttcaccgactgtaccacgtacgaacgtaccgtaggactacgtaagtacgtttcttacgcgttaagtacttacgttactcgtacgacgtacgtacggttcgttacgtacccgtaacgtaccgttaacgtttaccgggttaccgaccgggtaaacgggtacctaggacggttaacggtacttaaccgtaaaacgaccggttgaggtacccgtacgacctaccacgttcgttacccg

SEQ ID NO: 176866 - DNA, 785 bp, Homo sapiens
  misc_feature: GYAE6OF01E2QJ8.10.35.D02.1.454.CMB.1.raw
  modified_base (123)..(123): a, c, t, g, unknown or other
  misc_feature (123)..(123): n is a, c, g, or t
  modified_base (312)..(312): a, c, t, g, unknown or other
  misc_feature (312)..(312): n is a, c, g, or t
  modified_base (585)..(585): a, c, t, g, unknown or other
  misc_feature (585)..(585): n is a, c, g, or t
tcagcatagtagtgcacgaccggtgctcgatttagcacacgatagttgggtttggggctgggagaggcgccccagccctgggattcccaagtgtcttcattcagtgatcgagacgtagaacanagacgacctacaccagttggtaggttttacggcgtaggtagggttacgttactttttcccgtgcgttacgaacttttaaaagttttaaacgggcttccgtagtgtcgtagtcgacgtgttaggagtacgtcggtagggacgtcggtacgacgacgtcgggaggtaccgtccgtgaacgtcctcgtcgtncggctacgtcgcgtacggtacgtaggttacctactaacgttaattcggtacttacacggtcctaccggtacggccccggtaccgtaaccgccgggtcccgaacgggaggttaacgggctaacgggtagtacgtaacgtactacgttacggtttaaccacggtatacgtacgaacgtaaaccctaaaccgtagtaactaccgggcggtaacgttaggttacgggaccgggcgtacggcgtacgtctaacgtccgaccgacgtaacgacgtaacncgtaaacaccggtactacgaccgttactaacgactaacgacgtaacgacgttacgtacggtaacgacgtaaccgggctaaccggttacgtacccgtacgtttaccgttgggtaacgttaccggtaaacggtacggaaacgggttccggttaaggtacgttacggtttaaagtcgggtttcccggttagggtaacccgggg

SEQ ID NO: 176867 - DNA, 750 bp, Homo sapiens
  misc_feature: GYAE6OF01BXJ2N.10.35.D02.1.454.CMB.1.raw
  modified_base (194)..(194): a, c, t, g, unknown or other
  misc_feature (194)..(194): n is a, c, g, or t
tcagcatagtagtgcacgaccggtgctcgatttagcacacgatagttgggtttggggctgggagaggacgccccagccctgggattcccaagtgtcttcattcagtgatcaggactgaacacagagactcaccagtgtaggtttggctggagggttggtacttttccgttgactgactaaagttttaaaaggtntacgagtgtagacgtgagtaggttggaggtaggtcggtagggggagtacgtttaggggttaaacggggtcccggggggttacccttaggtacttccgttcgttacgttaccgtacggtccttacgttaggactttaccgaggttacgtacaacttaacggcgttagagtacggacgtcggtcggaccgaccctacggtaccccggaggggaacggtcgtagggtacggttgggttcggtaccttaagttaggaagaccgtaagtaccgtagacggtggtaaccggaaataacgtaggaactaccggtagttaaggttaacgtaacgggtaaaacgccgtaaggtactaccggactaactcctataagtagacgtagtaacgtaacaaacgaactacgtatacgtagaacgtaagcgaaggtacgacgtaccgaggtaactagacgtacgacgactaaccggtattacgttaagtacttagaaaccgtaagtaaacgtaccgaaccgtaaacggtaagaacgtacggggaggaaacggtcgtaggtccggtacgggg

SEQ ID NO: 176868 - DNA, 783 bp, Homo sapiens
  misc_feature: GYAE6OF01AVWCV.10.35.D02.1.454.CMB.1.raw
  modified_base (536)..(536): a, c, t, g, unknown or other
  misc_feature (536)..(536): n is a, c, g, or t
tcagcatagtagtgcacgaccggtgctcgatttagcacacgatagttgggtttggggagctctgggagaggagccccagccctgggattcccaagtgtcttcattcagtgatcaggactgaacacagaggactcaccatggagtttgggctggaggtggtatttttccttgctgacttaaagttttaaaggtgtcctagttgtacggacggtgtacctaggttgggtgggacgtcgggtaggggggaggtcgtttggggttaaacggggtcccggggggggttaccccttaggaccttccgttccgttggttcctacggtacctcgtgggtacttccgtagttaccgtccgtaaccgtaaccggtccgtaggtactcgaacggtcggttccggggtcccgaccgtaccggtacccgggaggggtaaccggggcgtagggtcggttcggggttacgtacccgtttaagtaggaacggccgtaaggtaaccgtaggtaggtacgggaacgggtaacaacggtacgaaggttaacccgnggtacggtaaacgtttaaggaaaacggccgtaagtacgtaccgtacgtactacgttagtacgttagtagtcgtaacggtaacaagtaaccgtacgttaagtacgtaccgtagtaacgtacgagacgacgtaacggagtaacgtacgactaacggaacgtaactaggtaccttagttaacgtacgttacgtaacgtacgtaacgacgtacccgagtaacgtacggtaggtacgggacggtagtacggg

SEQ ID NO: 176869 - DNA, 807 bp, Homo sapiens
  misc_feature: GYAE6OF01C9414.10.35.D02.1.454.CMB.1.raw
tcagcatagtagtgcacgaccggtgctcgatttagcacacgatagttggggtttgggggagctgctcagttaggacccagagggaaccatggaaaccccagcgcagcttctcttcctcctgctactctggcctccaagaaaccgaccggagaagttgtgtgacgctacgtcctccacggcctaccttgttctttcgtctaccggaaaggggaacacgccctaccctctcctgcgacgggccagtactacttagtaggttagactaaactaacttacgttacgtcgttggtacgacgagtaccaacgaaaccgtcggaccgacggtcctaccgacgtcctaccgtcatcgttatcgaccttcgactactccgtacgtacggaccggtccctagtccgggtaccaccggtaacccgaggttacgaacggtcgttaaccggacgggtacgggtaggtaaccgggggtttgggtaacccgggtacgggtaacctaacgggttacccttaccgtaaaccgttcctaaccctaaccgtaacgtacggaacccggtaaggaccggaacgggttacgggcgttaacggtaagggtttaacctttcgtacgttaccggtaactttcgtttaacgtcgtacgtacggaacgtttacgttaaccggttacgtaccggtaaccgtaccccttaacgggttaaacttcggggttaaccgggacggaccggggttaaccaggttaccgaacgggtaaccggtaactaaacggtaaacccggttgtaccggtgtacccaggttaacccacgtttcggttacc

SEQ ID NO: 176870 - DNA, 512 bp, Homo sapiens
  misc_feature: GYAE6OF02GCNPG.10.35.D02.1.454.CMB.1.raw
  modified_base (355)..(355): a, c, t, g, unknown or other
  misc_feature (355)..(355): n is a, c, g, or t
  modified_base (512)..(512): a, c, t, g, unknown or other
  misc_feature (512)..(512): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaaggactgctgggccagggancccttgcaccgtctcctcagcctcaccaagggcccatcgtcttcccctggccgccctgcctccaggacgccacctccgagacgcacagcggccctgggcctgcctggtccaaggactactcccactactatgctgacgcggctggcaggcgcatagn

SEQ ID NO: 176871 - DNA, 521 bp, Homo sapiens
  misc_feature: GYAE6OF02IXZHE.10.35.D02.1.454.CMB.1.raw
  modified_base (200)..(200): a, c, t, g, unknown or other
  misc_feature (200)..(200): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttgcagcacaaacctggccaggctccaggctcctcatctatgctgcatccatcagggccactggcatcccaggcagattcagtggcagtggtctgggacagacttcactctcaccatcagcagactggagcctagaagtatttgctagtcttattactgtacagctagtagtcgtactacgtaccctaagtaacgttttcggaccgtacgggaccgaagtcgtaggagtaagtacgaacgaacgtggtacggcgtacgcactatacg

SEQ ID NO: 176872 - DNA, 537 bp, Homo sapiens
  misc_feature: GYAE6OF02G8FQ2.10.35.D02.1.454.CMB.1.raw
  modified_base (477)..(477): a, c, t, g, unknown or other
  misc_feature (477)..(477): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttaggactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgcatctcaattgatgagtcaaagaacaccgtgtatctaggaaatgagcagcctaggaagcgatgacacgaggactntattattgtaccaataacgagtcccaacgaagactggtagggaagggactggcgtcgggg

SEQ ID NO: 176873 - DNA, 548 bp, Homo sapiens
  misc_feature: GYAE6OF02GN9FC.10.35.D02.1.454.CMB.1.raw
  modified_base (547)..(548): a, c, t, g, unknown or other
  misc_feature (547)..(548): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagagtcccacgaagactgtgggaaggactgcgtggggccaggggacgcccgttgtcaccgtctcctcacgcctccaccaacgggcccagtccggtccttcccccgtcggccgccctcgcctccgacggacgccacctccgagacgcacacgccggcccgtgggctcgccgtcggtacgaacggacctaccttcccactactatcgctgacggcggctggcaacggccgacagtagnn

SEQ ID NO: 176874 - DNA, 601 bp, Homo sapiens
  misc_feature: GYAE6OF02H9C16.10.35.D02.1.454.CMB.1.raw
  modified_base (268)..(268): a, c, t, g, unknown or other
  misc_feature (268)..(268): n is a, c, g, or t
  modified_base (599)..(599): a, c, t, g, unknown or other
  misc_feature (599)..(599): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaaggcagattcgccatctcaattgatgagtcaaagaacaccgtgtatctggaaatgancagcctggaaagcgatgacacaggactctatattgtaccactaagagtcccacgaagactgtgggaaggactgcgtgggccaaggggacgcccttgccaccgtctcctcacgtccctaccgacccgaacgggccccacgttccggtcccttccccccgtcgggcccgccccgtcgcgtcccgacggacgccgacccgtccgacgacgccaccgacggcccgggccctcggggcctcggcccgttcgggtaccaaacgggtaccttaccgttcccaccttactactcggcgtcggacggccgggcgtggaccaacgggccgtacgagtacgncg

SEQ ID NO: 176875 - DNA, 519 bp, Homo sapiens
  misc_feature: GYAE6OF02J0HMZ.10.35.D02.1.454.CMB.1.raw
  modified_base (446)..(446): a, c, t, g, unknown or other
  misc_feature (446)..(446): n is a, c, g, or t
  modified_base (509)..(509): a, c, t, g, unknown or other
  misc_feature (509)..(509): n is a, c, g, or t
  modified_base (517)..(518): a, c, t, g, unknown or other
  misc_feature (517)..(518): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagacaccgtgtatctggaaatgagcagcctggaaagcgatgacacaggactcattatgtaccactaagacgtcccacgaagactgtgggaagggactgctgggccaggggagcccttgtcaccgtctcctcagcctccaccgaagggcccatccggtccttccccctggccgccctgcctccaggcgcacctccgagacgcacncgcgcctggcctgcctgtcaacggctacctccactacatcgctgagcggtctggacgacggcncgactagnng

SEQ ID NO: 176876 - DNA, 711 bp, Homo sapiens
  misc_feature: GYAE6OF02H2GHA.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcgttggttaagccgggggggtccttagactctcctgttcagcctctggattcagtgtcactaacgcctggatgagctgggtcccgccacggtccccgaaggggaacggggcgtgggaggtgggttcggcctttagttaggaagcgagacctgagtggtagggacaacgagagtacgcgtggtacttacggtaaaaggcaaggtactttacgacctaagttctacgtaaattttggaacttaggtaagtacaaaaaggtaaaccgaacccggttagttaacgttaccgttaagggtaaaacttggaaacgccgtaacggtacccgtaaggggaaaacggccggtaaagtacggaaaccgaccgaaagggtaacctttacgttaatttacgttttacgttaaccccgtaaagttaaacgtacggttaaccccgaaacgaacggttaacgtacgggtaacggggtaacggggacttacgggaccggtacgggggg

SEQ ID NO: 176877 - DNA, 513 bp, Homo sapiens
  misc_feature: GYAE6OF02JA6X7.10.35.D02.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgacaactacttagcctggttgcagcacaacctggccaggctcccaggcctcctnatctatgctgcatccatcagggccactggcatcccaggcagattcagtgcaggtgggtctgggacagtcttcactctcaccatcagcagactggacgcctagaagtatttgctacgtcttattctgtcagcagtatcgtacacgtacctaagtactttcggccgacgggacctaggcgtaggacgtacgtacaacgtaactggtcggctcgacctacgtatcg

SEQ ID NO: 176878 - DNA, 561 bp, Homo sapiens
  misc_feature: GYAE6OF02JEJXI.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaatttaaaggtgtccagtgtgacgtgcagttgggtggagtctggggggaggcttgggttaagccgggggggtcccttagactctcctgttcagcctctggattcagtgtcactaacgcctggatgagctgggtccgccagtccccgagggaacggggctggaggtgggttggccttagttagaagcaggacctggagtggtgggacaacgagagtacgcgtggtattacgtaaaaggcagattcgccatctacaattgatgagtacaaagaacaccgtgtatacgtaggaatgagcagcgtaggaagcgatacgacacgaggactatattattacgtaccaactaacgagtacccgaagaacgacgtagtacgggaaggactggcgtacgggg

SEQ ID NO: 176879 - DNA, 543 bp, Homo sapiens
  misc_feature: GYAE6OF02GX0DN.10.35.D02.1.454.CMB.1.raw
  modified_base (436)..(436): a, c, t, g, unknown or other
  misc_feature (436)..(436): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttgggttaagccgggggggtcccttagactctcctgttcagcctctggattcagtgtcactaacgcctggatgagctgggtccgccagtcccccaggggaacggggctgggagtgggttggccttattagaagcagacctgatggtgggacaacagagtacgctggatcgtaaaaggcagatcgccatctcaattgatgagtcaaagaacaccgtntatctagaatgagcagcctaggaaagcgatgacacgaggactctattacttagtacctaactaagacgtacccacgaagactggtagggaagggactggcgtcgggg

SEQ ID NO: 176880 - DNA, 595 bp, Homo sapiens
  misc_feature: GYAE6OF02HG95F.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaatttaaaaggtgtccagtgtgacgtgcagttggtggagtcgtgggggaggcttggttaaggccgggggggtcccttaggactctcctgttcagcctctggattcagtgtcactaacgcctggatgagctgggtccgccagtccccgagggaacgggctggagtgggttggcctttagtagaagcagacctgatggtggacaacgagagtacgctggattacgtaaaaggcagagttcgactatctacaattgactgacgtacgaaaacgacaaccgtagtaactcgtaggaaacttggaagtacaaggccgtaagggaaacgcgaagtagaacaacgaaggactacgttaattacgttacgtaccgaacgtaagaccgtacccgaacgaagtactagggtagggaacgggtactggacgtacgggg

SEQ ID NO: 176881 - DNA, 545 bp, Homo sapiens
  misc_feature: GYAE6OF02JFW1X.10.35.D02.1.454.CMB.1.raw
  modified_base (303)..(303): a, c, t, g, unknown or other
  misc_feature (303)..(303): n is a, c, g, or t
  modified_base (450)..(450): a, c, t, g, unknown or other
  misc_feature (450)..(450): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccnccaggtcccccaggggaaggggctgggagtggggttggccttagtagaagcagacctgatggtgggacaacgagaggtacgctggattcgtaaaaggcagatcgcatctcaattgatgagtcaaagaacacgtgtatctagaatgancgagcctaggaaagcgatgacacgagactctattattagtaccaactaagactacccgacgaagactcggtagggaagggactggacgtacgggg

SEQ ID NO: 176882 - DNA, 567 bp, Homo sapiens
  misc_feature: GYAE6OF02IDQT1.10.35.D02.1.454.CMB.1.raw
  modified_base (417)..(417): a, c, t, g, unknown or other
  misc_feature (417)..(417): n is a, c, g, or t
  modified_base (531)..(531): a, c, t, g, unknown or other
  misc_feature (531)..(531): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggagcttggttaagccggggggtcccttagactctcctgttcagcctctggattcagtgtcactaacgcctggatgagctgggtccgccacggtccccaggggaaggggctgggagtgggttggccttattagaagcagacctgatggtgggacaacgagagtacgctggattacgtaaaaggcagtattcgccgagtcctanaattgatgagtcaaagaacaccgtagttactactagaaatgagcagccaggaagcgatcgacacgacgaactctaattacttagtaacaacgttaacgacgtacccaacggaanaccgttaggtacgggaagggacttcggcgtacgggg

SEQ ID NO: 176883 - DNA, 567 bp, Homo sapiens
  misc_feature: GYAE6OF02FOL2F.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtcccccaggggaaggggctggagtggggttggccttattagaagcagacctgatggtgggacaacagagtacgctggattcgtaaaaggcagattcgccatctacaattgatgagtacaaagaaccaccgtgtatctaggaaatgagcagcctagggaaagcgagtgacaacgaggactctaatttattacgtaacctaacttaacgacgtacccgaacgaagtacgttaggtacggggaaggacgtaggacggtcgggg

SEQ ID NO: 176884 - DNA, 600 bp, Homo sapiens
  misc_feature: GYAE6OF02I76SC.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcgttgggttaaggccgggggggttcccttaggactctcctgttcagcctctggattcagtgtcactaacgcctggatgagctgggtcccgccacgtcccccgaggggaaggggctgggaggtggggttggccttagttagaagcagacctgagtggtgggacaacgaggacgtacgcgtaggattacgtaaaaggcaaggtacttccgccatactactaattgatgatacaaagaacacgtgtatctaggaaatgagcagccgtaggaaagcgaagtcgaacacgaggtactcttaattacttagtaacctaacgtaaacgacgtacccgaacggtaaagtacgtagggtagggaacgggtacgtggaccggtacggggg

SEQ ID NO: 176885 - DNA, 545 bp, Homo sapiens
  misc_feature: GYAE6OF02IIWBG.10.35.D02.1.454.CMB.1.raw
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttgggttaagccgggggggtcccttagactctcctgttcagcctctggattcagtgtcactaacgcctggatgagctgggtccgccaggtcccccgaggggaacggggcctgggaggtgggttggccttagttagaagcagacctgatggtgggacaacgagagtacgctggattacgaaaaggcagattcgacatctacaattgatgagtcaaagacacgtgttatctaggaatgancagccgtaggaagcgatgacacaggactntattatcgtacactaagacgtacccaagaagactggtagggaaggactggcgtcgggg

SEQ ID NO: 176886 - DNA, 580 bp, Homo sapiens
  misc_feature: GYAE6OF02H6QU0.10.35.D02.1.454.CMB.1.raw
  modified_base (437)..(437): a, c, t, g, unknown or other
  misc_feature (437)..(437): n is a, c, g, or t
tcagcatagtagtgcacgaccggtgctcgatttagcacacgatagttgggtttggggggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttggttaagccggggggtccttagactctcctgttcagcctctggattcagtgtcactaacgcctggatgagctgggtccgccagtccccgagggaacggggctggagtggggttcgcttagttagaagcagacctgagtgggtggacaacgagagtacgctaggatacggtaagcagattcgcatctacattgatgagtacaaagacgaccgtgtatntaggaatgagacagcctaggaaacgcgagtgaacacgaacggtactacgtaattagttcgtaacctacgttaacgacgttacccgacggaacgtacgtagggtacgggaacgggacttaggccgttagggggacctaacgggg

SEQ ID NO: 176887 - DNA, 583 bp, Homo sapiens
  misc_feature: GYAE6OF02GPOVV.10.35.D02.1.454.CMB.1.raw
  modified_base (581)..(581): a, c, t, g, unknown or other
  misc_feature (581)..(581): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactggtgggaagggactggctggggccaggggacgcccttgccaccgtctcctcagcctccaccaagggcccagtccggtccttcccccgtcggccgcccgtcgcctcccgacggacgccacctccgagacgcacacgccggccctcggggcctcgccgtggtaccaacggtaccttaccgttaccccacgttacctacgtcggacgtacggacggtccgggtacgtcgggacgaacgggccgacgagtacggncg

SEQ ID NO: 176888 - DNA, 575 bp, Homo sapiens
  misc_feature: GYAE6OF02H4PB3.10.35.D02.1.454.CMB.1.raw
  modified_base (374)..(374): a, c, t, g, unknown or other
  misc_feature (374)..(374): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagttttgggctgaggtggattttccttgctgcaattttaaaaggtgtccagtgtgacgtgcagttggtggagtctgggggaggcttggttaagccggggggtcccttagactctcctgttcagcctctggattcagtgtcactaacgcctggatgagctgggtccgccaggtcccccaggggaaggggcctgggaggtgggtggccttattagaagcagacctgatggtgggacaanagagtacgctggattcgtaaaggcagatttcgccatctacattgatgagtcaaagacacgtgtatctaggaatgagcagctaggaagcgatgacaacgaggactacgtattacgttagtacctaacttaagacgtacccgaaccgtaaggaccgttagggtacggggtaacggggtaccgttacgggacgttaccgggggg

SEQ ID NO: 176889 - DNA, 627 bp, Homo sapiens
  misc_feature: GYAE6OF02H1POR.10.35.D02.1.454.CMB.1.raw
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (380)..(380): a, c, t, g, unknown or other
  misc_feature (380)..(380): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaaggccggggggtcccttagactctcctgttcagcctctggattcagtgtcactaacgctgatgagctgggtccnccgacgtccccgaggggaaggggctagggnggtggttggcctttagttagagtcagacctggatggtagggacaacnggagtacgcgtaggattacgtaaaaaggcagacttcgaccagtctacaattgatagatacaaagacaccgtagtactcgaggtaaatgaagcgagaccgtaaggaaaggcgaatcgaaccaacgtaacggaacttcgttaatttacgtttcgtaaaccgtaacgttaaacggaaccgttaccccgaacggtaaacgacggtttacgggaacgggggtaaacgggacttacggggcggtaaccggggg

SEQ ID NO: 176890 - DNA, 557 bp, Homo sapiens
  misc_feature: GYAE6OF02FS6UR.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttgggttaagccgggggggtcccttagactctcctgttcagcctctggattcagtgtcactaacgcctggatgagctgggtccgccagtccccgagggaggggctggagtggggttggccttagtagaagcagacctgatggtagggacaacgagagtacgctaggattacggtaaaaggcagattcgaccatctcaattgatgagtacaaagaacacgtagtatctaggaaatgagcagacctaggaaagcgatgacacaggactactattattacgtaccgtaactaagacgtacccaagaagacgtaggtacgggaaggactcggcgtacgggg

SEQ ID NO: 176891 - DNA, 581 bp, Homo sapiens
  misc_feature: GYAE6OF02IK91L.10.35.D02.1.454.CMB.1.raw
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcgttggttaaggccgggggggtcccttaggactctcctgttcagcctctggattcagtgtcactaacgcctggatgagctgggtccgccagtcccccgagggggaacggggcgtggaggtgggttggtccttagttagaagcagacctgagtggtgggacaagagagtacgctaggattacgtaaaggcaagacttcgcctatcctanaattgatgaagtacaaanaaccacgtgtatctagaatgagcagccgtaggaagcgatagacaacgaggtaactctagtttacttcgtaacctactaacgacgtacccgacgaaagtcgtaggttacgggaagggtaccgtggtacggtacgggg

SEQ ID NO: 176892 - DNA, 590 bp, Homo sapiens
  misc_feature: GYAE6OF02IL9DR.10.35.D02.1.454.CMB.1.raw
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (472)..(472): a, c, t, g, unknown or other
  misc_feature (472)..(472): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttggttaaggccgggggggtcccttagactctcctgttcagcctctggattcagtgtcactaacgcctggatgagctgggtccgccaggtcccccaggggaagggctggagtgggttgcttattagagcagcctgatggtggacaacngagtacgctgattacgaaaggnaagnttcgccatctacaattcgatgtagtacaaagaaccaccgtgtattacgtaggaaatgatacgacgaccgtagggaancgatacgaacacgaacggaaccttctaatttacttacgtaacccaacttaaacgaccgttaacccaaggaacgtaccgttaggtaacggggaacgggacgttaggacggtaccggggg

SEQ ID NO: 176893 - DNA, 561 bp, Homo sapiens
  misc_feature: GYAE6OF02IV3AV.10.35.D02.1.454.CMB.1.raw
  modified_base (262)..(262): a, c, t, g, unknown or other
  misc_feature (262)..(262): n is a, c, g, or t
  modified_base (383)..(383): a, c, t, g, unknown or other
  misc_feature (383)..(383): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggatttccttgctgcaattttaaaaggtgtccagtgtgacgtgcagttggtggagtctgggggaggcttggttaagccggggggtcccttagactctcctgttcagcctntggattcagtgtcactaacgcctggatgagctgggtcccgccaaggtccccgagggggaacgggcgtgggaggtggggttcggcctttagtagaagcagacctgagtggtaggaacaacgngacgtacgcgtggaattacgaaaaggcagacttcgacctagtcctacgaattgatgagtacaaagactaccgtgttatacgtagaaatgagctagcctaggaancgatgacagngactctatatanaccgataagacgtaccagtaagacgtaggtagggaaggtctggacgtcgggg

SEQ ID NO: 176894 - DNA, 539 bp, Homo sapiens
  misc_feature: GYAE6OF02GHVTG.10.35.D02.1.454.CMB.1.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaagccgggggggtccttagactctcctgttcagcctctggattcagtgtcactaacgcctggatgagctgggtccnccagtccccagggagggctggagtgggttgccttatagagnagacctgatggtgggacaacgagagtacgctggattcgtaaaaggcagatttcgcctatctcaattgatgagtacaaagaacaccgtgtatcgtaggaaatgagcagcctaggaaagcgagtagacacaggactgtattatgtaccataagacgtacccagaagactacggtagggaacggagtagcgtcgggg

SEQ ID NO: 176895 - DNA, 571 bp, Homo sapiens
  misc_feature: GYAE6OF02G93W1.10.35.D02.1.454.CMB.1.raw
  modified_base (303)..(303): a, c, t, g, unknown or other
  misc_feature (303)..(303): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggagcttggttaaggccgggggggtcccttagactctcctgttcagcctctggattcagtgtcactaacgcctggatgagctgggtccnccagtcccccgagggaacggggctgggagtggggttggcctttagtagaagcgagaccgtgagtggtgggacaacgagagtacgcgtggattacgtaaaaggcagattcgccatctcaattgatgagtacaagaacacgtgtatctagaatgagcagccgtagaagcgatcgacacgagtactcgtattattacgtaacctaacgtaacgacgtaccccgaagtaacgtacgtacggtaggggaacgggtacgtaggcgtaccggggg

SEQ ID NO: 176896 - DNA, 576 bp, Homo sapiens
  misc_feature: GYAE6OF02FHYLF.10.35.D02.1.454.CMB.1.raw
  modified_base (471)..(471): a, c, t, g, unknown or other
  misc_feature (471)..(471): n is a, c, g, or t
  modified_base (509)..(509): a, c, t, g, unknown or other
  misc_feature (509)..(509): n is a, c, g, or t
tcagcatagtagtgcacgaccggtgctcgatttagcacacgatagttgggtttggggagctctgggagaggagccccagccctgggattcccaagtgtcttcagttcagtgatcaggactgaacacagaggactcaccatggagtttgggctgaggtggatttccttgctgcatttaaaaggtgtccagtgtgacgtgcagttggtggagtctgggggaggcttgggttaagccgggggggttcccttaggactctcctgttcaggcctctggattcagtgtcacttaacgcctggatgagctggggtccgccagtcccccgagggtaacggggcctggggacgttggggtttgggccctttaagttacggaaggtcaggaaccctggaatggtgggacaacagagtacgctggattcggtaaaaggcagacttcgcatctcaattgatgagtcaaagaacacgtgtatcngtaatgagcagcctgaaagcgaatgacacgaggtactntattagttgtaccaactaacgacgtacccaacggaacgtaccgtggtacgggaagggtacttacggg

SEQ ID NO: 176897 - DNA, 610 bp, Homo sapiens
  misc_feature: GYAE6OF02I94PF.10.35.D02.1.454.CMB.1.raw
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
  modified_base (466)..(466): a, c, t, g, unknown or other
  misc_feature (466)..(466): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggagcttggtaaggccggggggtcccttagactctcctgttcagcctntggattcagtgtcactaacgcctggatgagcgtgggtccnccgagtccccgagggacgggctggaggtgggtcggcttagtagagcagacctgagtggtcgggacaacgaggacgtacggctaggaactttacggaaaaggctaaggtacttcgacctatactcaattgatgagtacaaagacacgtatatcaggtaatgacncgagtaccgagggaaacgcgaagtcgaaccgtaacgacggtactacttagttacgttacgaacccgtaagtaacggtaccgtaacccgaacggtaaacgtaccgttagggtaacggggaagggtacgtaggtaccggtacgggg

SEQ ID NO: 176898 - DNA, 533 bp, Homo sapiens
  misc_feature: GYAE6OF02HPB2S.10.35.D02.1.454.CMB.1.raw
  modified_base (304)..(304): a, c, t, g, unknown or other
  misc_feature (304)..(304): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
tcagcatagtagtgcacgaccggtgctcgatttagcacacgatagttgggtttggggagctctgggagaggagccccagccctgggattcccaagtgtcttcattcagtgatcaggactgaacacagaggactcaccatggagttttgggctgaggtggattttccttgctgcaattttaaaggtgtccagtgtgacgtgcagttggtggagtcgtgggggagcttggttaagccggggggtccttagactctctgttcagcctctggattcagtgtcactaacgcctggatgagctgggtccnccgagtccccgaggggaaggggctgggaggtggggttggccttagtagaagcagacctgatggtggacacagatacgctgattcggaaaagcagatcgacatactctaatgatgatacaaagacacgtntatctagaatgancagacctagaagngatgacacgagactactaattagttcgtaccaataacgaacgtcccaacgacgacgtggtagggaggtctacgg

SEQ ID NO: 176899 - DNA, 640 bp, Homo sapiens
  misc_feature: GYAE6OF02F4W0X.10.35.D02.1.454.CMB.1.raw
  modified_base (637)..(637): a, c, t, g, unknown or other
  misc_feature (637)..(637): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagagcagacctgatggtgggacaacagagtacgctggattacgtaaaaggcagattcgccatctcaattgatgagtacaaagacacgtgtatctggaaatgagcagcctaggaaagcgatgacacaggactctattattcgtaccataagacgtacccaaggaacgactggtagggaagggactggccgtggggacccgaaggggacgcccgtttggtacccaccggttcctccctcgaccgccctaccgacccgaaacgggcccctacgttcccggttcccttcccccgtcggtcccgcccgttcgcctccgacggtaccgccgaccctccgacgaccgacaccgacgccggcccgtcgggccgtacggccgtcgggtaccgaacggtaccttacccttaccctaacttacgttaacgtccgcgttacgggacggccgggtcgtacgggacgacggtccggacgacgtagngcg

SEQ ID NO: 176900 - DNA, 594 bp, Homo sapiens
  misc_feature: GYAE6OF02F7BXJ.10.35.D02.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaaacctggccaggctccaggctcctcatctatgctgcatccatcagggccacgtggactccagccaggttcagcggcggtgggtctgggacagacttcactcncaccatcagcagcctagcagtctgacggtaccttggacttttattacgtgtacaggtctacgttactctaagtacctcgggtcccttccggttacgggtaccgtttcggaccgtaaacggggaccgtaacgggtaccggaacccttaaccggaaaacggtaaccgttagggtacggtacccgtggtaacctacccgtaattccggttacgttaccgttacgtacccg

SEQ ID NO: 176901 - DNA, 573 bp, Homo sapiens
  misc_feature: GYAE6OF02IRORH.10.35.D02.1.454.CMB.1.raw
  modified_base (358)..(358): a, c, t, g, unknown or other
  misc_feature (358)..(358): n is a, c, g, or t
  modified_base (571)..(572): a, c, t, g, unknown or other
  misc_feature (571)..(572): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagacaccgtgtatctggaaatgagcagcctaggaaagcgatgacacaggactctattattgtaccactaagacgtcccacgaagctgtgggaaggactggcgtgggccagggganccccgttgtcaccgtctcctcagccctccgacccgaacgggcccagtccggttcccttcccccgtcggccgcccctcgcctccgacggacgccacctccgacgacgcacgcgccggcccgtcgggctcgccgtcggtctacggaccttaccgtaccctaccttactactcggctcggacggccgggtcgtcggcgaacggcgacgacgtaggnng

SEQ ID NO: 176902 - DNA, 657 bp, Homo sapiens
  misc_feature: GYAE6OF02ICM5U.10.35.D02.1.454.CMB.1.raw
tcagcatagtagtgcacgaccggtgctcgatttagcacacgatagttgggtttgggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggagcgttgggttaaggccggggggtcccttaggactctccgtgttcagcctcgtggattcgagtcgtacacgtaaccgcctggatggagcgtggggtcccgccgacggtcccccgaaggggaacgggggccgtagggaggttgggttcggacctttagttaggaattcgagtaccgtagtagtggtgggacaacgagagtacgcgtaggtattaacggtaaaaggcgtagtattccgacctatcgtactaagtttgagtagtaacgtacaaaaggtaacctacggttagttaacgttacgtaggtaaatgagactagaccgtaggaacgcgtaagtacgaacgaacgagaaccttattattacgtacgtaaccgactaaaggtccgtacccgaaggtaacgtacgttagggtacgggtaaagggcgttaggccggtacgggg

SEQ ID NO: 176903 - DNA, 573 bp, Homo sapiens
  misc_feature: GYAE6OF02FO4FB.10.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (396)..(396): a, c, t, g, unknown or other
  misc_feature (396)..(396): n is a, c, g, or t
  modified_base (567)..(567): a, c, t, g, unknown or other
  misc_feature (567)..(567): n is a, c, g, or t
tcagcatagtagtgcacgaccggtgctcgatttagcacacgatagttgggtttggggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaangccaccctctcctgcagggccagtcactatgttagtgaacaacttacttagccttggttncagcacaaacctggccaggcctcccgaggctcctcatctatgctgcactccatcgaggccactggcactccaggcacgtattcgaggtcggcagggtcggggtcgggtacgagtacgttcacgttcctcgacctntccgagtcagtccctggactacgtctaggtaagttgttttgacttagtttattacgtgtactagtcgtaagtatcgtacttaccgtcgtaccttcgtacgttacggttcgggaccgggtacagtcgtaaggaactacggaacgtcgtaacgttggcgacgtcgactacctnttaccg

SEQ ID NO: 176904 - DNA, 602 bp, Homo sapiens
  misc_feature: GYAE6OF02I4KWA.10.35.D02.1.454.CMB.1.raw
tcagcatagtagtgcacgaccggtgctcgatttagcacacgatagttgggtttgggggggagaggagccccagccctgggattcccaagtgtcttcattcattgatcaggactgaacacagaggactcaccatggagtttgggctgaggtggattttccttgctgcaattttaaaaggtgtccagtgtgacgtgcagttggtggagtctgggggagcttggttaagccggggggtccttagactctcctgttcagcctctggattcagtgtcactaacgcctggatgagctgggtccgccacgtccccgaggggaacggggctgggaggtggggttggccgttagtagaagcagacctgatgggtggacaacgagagtacgcgtggattacggaaaagctaagattcgacctatctacaattcgatgagtacaaagactacgtgtatcgtaagaatgagacagaccgtaggaaacgcgagtacgaacacgaggtaaccttacttaattagttacgtacctaacgtaacgacgttaaccccaaggtaacgaccgttagggtagggaacgggtcgtaggccggttacggggaccgtaacggggg

SEQ ID NO: 176905 - DNA, 619 bp, Homo sapiens
  misc_feature: GYAE6OF02JEBFV.10.35.D02.1.454.CMB.1.raw
  modified_base (361)..(361): a, c, t, g, unknown or other
  misc_feature (361)..(361): n is a, c, g, or t
  modified_base (616)..(616): a, c, t, g, unknown or other
  misc_feature (616)..(616): n is a, c, g, or t
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactggtagggaaggactgcgtggggccaggggacncccgttggtcaccgtctcctcacgcctacccaccgaacgggcccagtcccggtccttcccccgtcggcccgtcccgtcgccttccgacgggacgccgtacccgtccggacgacgccaccgacggcccggcccgtgggccgtcggcccgtgggtaccaaacgggtaccctaacccgttccctaaccgttacctacgtcggtcgtacggtacgggtccgggtcgtacgggaccgtaacgggcccgactacggtacgngcg

SEQ ID NO: 176906 - DNA, 549 bp, Homo sapiens
  misc_feature: GYAE6OF02G9C62.10.35.D02.1.454.CMB.1.raw
tcagcatagtagtgcacgaccggtgctcgatttagcacacgatagttgggtttggggagctctgggagaggagccccagccctgggattcccaagtgtcttcattcagtgatcaggactgaacacagaggactcaccatggagttttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtcccgccagtccccaggggaagggctggagtgggttggccttattagagcagacctgatgggtgggacaacgagagtacgctggattcggaaaaggcagattcgccatctcaattgatgagtcaaagacaccgtgtatctgaaatgagcagcctaggaaagcgatagacacaggactactattacgttgtacctaactaagaccgtacccgacgaacgtaccgtggtacggggaaggacgtacgg

SEQ ID NO: 176907 - DNA, 571 bp, Homo sapiens
  misc_feature: GYAE6OF02GHBHW.10.35.D02.1.454.CMB.1.raw
  modified_base (389)..(389): a, c, t, g, unknown or other
  misc_feature (389)..(389): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaagccgggggggtcccttagactctcctgttcagcctctggattcagtgtcactaacgcctggatgagctgggtcccgccacgtcccccgaggggaacgggcgtggaggtgggttggccttagttagagcagacctgatggtagggacaacgagagtacgngtaggattacgaaaaggcagattcgccatctacaattgatgagtacaaagaaccaccgtagtatcgtaggaaagtgagcagacgtaggaagcgatacgacacgaggactatattattcgtaccaacgtaagacgtacccaacgaagtacgtacggtagggaacggacgtggaccgtacgggg

SEQ ID NO: 176908 - DNA, 687 bp, Homo sapiens
  misc_feature: GYAE6OF02JFRY7.10.35.D02.1.454.CMB.1.raw
tcagcatagtagtgcacgaccggtgctcgatttagcacacgatagttgggtttgggggggtcccttagactctcctgttcagcctctggattcagtgtcactaacgcctggatgagctgggtccgccagtccccagggaagggctggagtgggttggccttattagaagcagacctgatggtgggacaacagagtacgctggattcgtaaaaggcagattcgccatctacaattgatgagtacaaagaacacgtgtatctagtaaatgaagcagcctaggaaagcgatgacacaggactctattatgtaccactaagacgtacccacgaagactggtaggaaggactgcgtgggccgagggacgtcccgttagtccgaccgttctcccgtcgaacgtcccgtacccgaaccgtaacggggacccctaacgtcccggttacccgtttccccccgtacggcccgtccccgtcgtacccgtaccgaacggtaccgaccgtacccgtacccggaacgtaccgaccacgtaccggacccgggtcccggtccggccgtacgcccgtacgggtaccgaaccgggtacttaacccgtaccctaaccgtaccgtttagtacccgtaccggttaggtaccgggtaccgggtccggtaccgggacggtaaccgggccgtaccggtaacgtacgacgtg

SEQ ID NO: 176909 - DNA, 568 bp, Homo sapiens
  misc_feature: GYAE6OF02FH0OI.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaagccgggggggtcccttagactctcctgttcagcctctggattcagtgtcactaacgcctggatgagcgtgggtccgccacgtccccgaggggaacggggctggagtgggttggccttagtagaagcagacctgagtggtgggacaagagagtacgctggattacgaaaaggcagtattcgctatctctaattgatgagtacaaagaacaccgtgtatcgtagaatgagacgagaccgtagggaacgcgaatagacacaggacttacttattattcgtaaccgaactaagacgtacccaacgaacgacgtggtagggaagggtacgtcggacgtcgggg

SEQ ID NO: 176910 - DNA, 684 bp, Homo sapiens
  misc_feature: GYAE6OF02I2GEV.10.35.D02.1.454.CMB.1.raw
tcagcatagtagtgcacgaccggtgctcgatttagcacacgatagttgggtttgggctgggagaggagccccagccctgggattcccaagtgtcttcattcagtgatcaggactgaacacagaggactcaccatggagtttgggctgaggtggattttcctgctgctaattttaaaaggtgtaccagtgtgacgtgcagttggtggagtcgtggggagtcgttggttaaggccgggggttccttagactcgtccgtgtcagcctctggattcgagtgtcacgtaacgctggactgagtcgtgggtccgccgacgccccgagggaacggggcgttgggaggtgggttcggaccctttagtaaggagaccgacgtaccgtacgagtcgggtacggaacaacgaggtagtacgtgtagggtagttaaccggaaaaggtcgaagtacgttccgactacgtccgtactaagttagaataggaacgtacgaaacgaacgtacccggttagttaacgtacgtaggtaaatcggaacgacgaagtaccgaagggaaacgcgtaagtacgaacgaaccggtacgtaaccgtacgttaagtttacgtaggttaacccaacgttaaccgaacccgtaccgtaaccgtaagtaaccggttacggtaggggtaaccggacgttacggcgtaacgggg

SEQ ID NO: 176911 - DNA, 615 bp, Homo sapiens
  misc_feature: GYAE6OF02HOYJF.10.35.D02.1.454.CMB.1.raw
  modified_base (200)..(200): a, c, t, g, unknown or other
  misc_feature (200)..(200): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgctccgaggggaaangccaccctctcctgcgacgggccagtcactatgttagtgacaactacttagcctggttgcagcaacaacctggccaggctccgaggctcctcatctatcgctgcatccatccgacgggccacgtggaccacgtccccgaggccagtacttacgaggtcggctagggtcgggtcgtagggactacgtacttcgaccttcaccaccatacacgacgagacgtggacgtccgtaggtaacgttagtttcgactagtacttacgttactgtacgagtacgtaagtacgttggtaccgtacgtaccgtaagttaaccgtttacgggacccgtacggggaccgtacggtaccgtagggacgtaacgtaaccgaaaccggtacgtacgggttacggtaccgtaccgaccgtaccgagttccg

SEQ ID NO: 176912 - DNA, 626 bp, Homo sapiens
  misc_feature: GYAE6OF02FSNFJ.10.35.D02.1.454.CMB.1.raw
  modified_base (271)..(271): a, c, t, g, unknown or other
  misc_feature (271)..(271): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaaggccgggggggtcccttagactctcctgttcagcctctggnttcagtgtcactaacgcctggatgagctcgggtccgccacgtccccgaggggagggcgtggaggtggggtggccttagttagaagcgagacctgacgtggtaggaacaacgagagtacgcgtaggattacggtaaaaggcaagtacgtttaccgcctactctactaagttagtatgtaacgtacgaaagaacccgtacgttgtaatcgtaaggtaaatgaacgacacgaccgtaaggaacgacgaacgtgaacctacgaacggtacttacttattacgtacgttaccgaacgtaaacgaccgtacccaacgaacggtacgtgggtaacgggaaggtaccgtggacggtccggggg

SEQ ID NO: 176913 - DNA, 592 bp, Homo sapiens
  misc_feature: GYAE6OF02F94KV.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttcctgctgcaattttaaaggtgtccagtgtgacgtgcagttggtggagtcgtgggggagcgttgggttaaggccggggggtcccttagactcctcctgttcagcctctggattcagtgtcactaacgcctggatgagtcgtgggtccgccgacgtccccggaggggaagggtctgggaggtgggttcggcctttagttagagcagcctgatggaggacaacgagagtcgcgtaggatttacgaaaggcaagacttcgacctatctactaattgatgatacgaaagacctacgtatacgtgtaggaatgagcaacgtcgaggaacgcgaagtcgaacaacgagtactacttattacgtacgtaacctaacgtaacgtaccgtacccgaacggtaagaccgttagggtagggaacggtacgtacggcggtacgggg

SEQ ID NO: 176914 - DNA, 616 bp, Homo sapiens
  misc_feature: GYAE6OF02JWVFF.10.35.D02.1.454.CMB.1.raw
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (419)..(419): a, c, t, g, unknown or other
  misc_feature (419)..(419): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (607)..(607): a, c, t, g, unknown or other
  misc_feature (607)..(607): n is a, c, g, or t
tcagcatagtagtgcacgaccggtgctcgatttagcacacgatagttgggtttggggagctctgggagaggagccccagccctgggattcccaagtgtcttcattcagtgatcaggactgaacacagaggactcaccatggagtttgggctgaggtggattttcctgctgctaatttaaaggtgtccagtgtgacgtgcagttggtggagtcgtgggggagtcttgggttaacggccggggggttcccttagactctccgttgttcagcctcgtggtattcagtgtcactaaccgctggatgacgctcgggtccnccagtccgagggagggctgggagtgggttcgcttagtagagcagactgngtaggtggacanggacgtgctaggaatacggaaagcagtactcgactatccttanaaacgtttgaagttacggaacgtacgtaaaacgaaccgtacgttacgtaagtaccgtaggtaaatacggacgtacgaacgttacgacggaaancgtaanacggaaacacgaacgtacttcttaagtttacacggttaaccaacgtaaggtaccctaccgtaacgacggtaagtcgggtaacgggtacngttaacggg

SEQ ID NO: 176915 - DNA, 561 bp, Homo sapiens
  misc_feature: GYAE6OF02GRGIZ.10.35.D02.1.454.CMB.1.raw
  modified_base (307)..(307): a, c, t, g, unknown or other
  misc_feature (307)..(307): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttgggttaagccgggggggtcccttagactctccgtgttcagcctctggacttcagtgtcactaacgccgtgatgagctgggtccncagtccccgagggaagggctgggaggtgggttggccttattaggagcagacctgatggtgggacaacgagagtacgctggattcgaaaagcagatcgcatctcaatnatgagtacaaagacacgtntatacagaatgancgagccgtaggaagcgatcgacacaggtactcgtaattatcgtaaccaactaacggtacgtacccgaacgtaacggtacgtaggtacggggaaggtacgtacggcggtacggggg

SEQ ID NO: 176916 - DNA, 774 bp, Homo sapiens
  misc_feature: GYAE6OF02HU1H3.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtatttttccttgctgactaattttaaaaggtgtccagtgtgacgtgctagttggtggagtcgtgggggagtcgttagggttaaggcccggggggtcccttagactctccgtgttcagcctcgtggattcgagtgtacaactacgcctgatgagctgggtccgccgacgtacccccgaaggggacggggctgggtacggttgggttacggtcctttaagttaacggaacgaccacggtacccgtaggtacgtagggtacgggaactaaacgaggtacgtaacggtcgtaagggtaacttaaccggtaaaaaggccgtaaaggtactttacccggacctaacttaccgtacgtaaagttttgaacgttaggtaacgttaaaccgaaaagtaacccgtaaccggtagttaaacgttacggtaagtaaaagttggaacgccgtaaggtaacccgtaagggaaaccgtaggtaacgttaagaaccgtaacgtacggttaaccttaacttacgtttaacgttacgtaaacccgtaacggttaaacgtacccgtaaacccgtaacggaacgttacgggttacggggtaacgggtaaacgggtacccgtacggaccggggtaccgggg

SEQ ID NO: 176917 - DNA, 810 bp, Homo sapiens
  misc_feature: GYAE6OF02FVE6I.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaggtgtccagtgtgacgtgcagttggtggagtcgtgggggaggtcgttagggttaacggccgggggggtcccttaggacttccgtccgttgttccagtccctctggtattcgagtcgtacactaaccgcctggactggacgtcgtcgggtccgccgtacgtcccccggagggggaacggggccgtagggacgggttcggggttcggtacccgtttagttaaggaacggtccgtaacggtacccgttggtacggttgggtacggggaaccgtaaacgaggtaacggtaaccggtcggtttacgggtaaacgtttaaccggtaaaaagggtccgaaagggttacctttaccggtacctaaccgttaccgttaacctaaagtttacggtaagttacggtaacggtaaactaaaaacggtaaaccctaacccgggtttagttaaacgtttaccgttaacgggtaaaagttcggaaacgtcgtaacggtaccggtaacgggaaacggtcggtaaacgtacggaaccgaacgacggtaacctacgttaacgtttacgtaccggtaaccgtaacgtaacgtacgtaaccccgtaagtaacggtacgtacgggtaggaacgggtactcggtacggtacgggg

SEQ ID NO: 176918 - DNA, 739 bp, Homo sapiens
  misc_feature: GYAE6OF02HIM84.10.35.D02.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctccagaaaccaccggagaagttgtgttgacgcagtctccaggcaccctgtctttgtctccgaggggaaanagccaccctctcctgcagggccagtcactatgttagtgaactaactacttagccgttggttgcagcaacaaacctggccaggcctccgagctcctnatctatcgctcgactactcctagtccgaccgggccctagtcggacctaccgtccccgagggaccaggtacttcgacggtggactagggttgggtacgtaggggaacctacggttaccttacgaccgttacctaccaaccgtactacgacgtacgaagtacgtacgggtacgtaccgtaagtaacgtttacgtttccggtacgttacgttacctttacgtttacgttacggttactaacgtacgttaaaggttacggttacgtaccgttaacccgttaaccgttaaacgggtttaaaccgttttaccgggaaccgggttaaccggggtacccggttaacggtaccgggtaagggttaacgtaaacgttaaaccgtaaaccggttaaccggttacgggttacggtacccgttaaccggtacccgttaaccgtaacgtttacccgg

SEQ ID NO: 176919 - DNA, 915 bp, Homo sapiens
  misc_feature: GYAE6OF02HWEP8.10.35.D02.1.454.CMB.1.raw
  modified_base (200)..(200): a, c, t, g, unknown or other
  misc_feature (200)..(200): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctcgaggggaaanagccaccctctcctgcagggccagtcactatgtttagagactaactacttacgccttggttgcagccaacaaccgtcggaccaggcctacccgaggtacctccctcgaacttccgtaatccggtactcggtacctaacttcccgaacgttccggaacggggtaccctaccgtacgggacctaccgtacccccgaagggtcctaaacggtacgtttccgaaggtttcggaccggtaggggttcgggtacgttacgggggaaactacggttaaccctttcgtaaccccggttctacccgaaaccctggtttacccgaaacggtccgtaacggtaaccgggtacggtaaccggtcccgttaaagggtaaaccggttttacgtttttccggaaaccgggttttacgttaacgtttaaccgttttaacggtccggttaacccgtaaagggttacccggtttaaagggttaaacggttccggggtttaaccccgttaaacccggggttttacccccgtttaaaaacggtttttaaacccggggtttttacccggggacccggggtaaaaccggggggttacccccgttaaagggttacccgggggtttaacgggaaaccgggttaaaccgtaaaccccgggtttaaaaacggtaacccgggtttcgggtaacccgggtaccggtttaacccggaacccttaaccgtttaacggtttcccgg

SEQ ID NO: 176920 - DNA, 712 bp, Homo sapiens
  misc_feature: GYAE6OF02J13QZ.10.35.D02.1.454.CMB.1.raw
tcagcatagtagtgcacgaccggtgctcgatttagcacacgatagttgggtttggggtcgtgggagaggagccccagccctgggattcccaagtgtcttcattcagtgatcaggactgaacacagaggactcaccatggagtttgggctgaggtggattttcctgctgcaatttaaaggtgtccagtgtgacgtgcagttggtggaggtctgggggagcttgggttaagccgggggggtcccttaggactcgtccgttgttacacgcctcgtggtattccaggtgttccaactacgccgtggatgagtcgtgggtccgcctacggtccccgagggaacgggcctggggtaggttgggttcggccgtttagttaggaacgccgtaggaccctaggacgtgggtcgggtaacaacgaagaggtaccgcggttaggacgtttaaccggtaaaacggcgtaaacggtacgttccgctaacgttctaaccgtaagttttcgaagtagtaacgtaaccgtaaaagtaaaccgtaaccggttacggttaagttaccgttaaggtaaacgtagtaagaccgtagaccgttaaggaagtaccgagtacgaactaccgaaggtaaccgtaccttaagttacgttcgttaaaccgtcgtaaacgtacggtaacccacggtaacgaccggttaggacgggtaaggccgttaggcgggtacgggg

SEQ ID NO: 176921 - DNA, 785 bp, Homo sapiens
  misc_feature: GYAE6OF02GAYWV.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttccttgctgctaattttaaaaggtgtccagtgtgacgtgcagttggtggagtcgtgggggaggcgttgggttaaggccggggggtcccttagactctcctgttcagtcctctggattcagtgtcactaacgcctggatgagtcgtcggtccgccacgtccccggaaggggaacgggcgtagggaggtgggttcggtccgtttaagttaacggaacgtcgaacgtacccgtaggagttcgggtagggaacaacgaggtaacggttacgcggttaggtaacgtttaacggtaaaaacggcgaaggtaactttaccgacctaacgttcctacgtaaagttgtaacgttcgtaaagtaccgtaaaaacggtaaccctaccggttaaggttaacttacgttaaagggtaaacgttcggaacgtaccggaacgttacccggtaagggtaaaacgtccgggtaagtaacgaaccgaaaccgtaacggtaacccgtttaacgttaacgttttaaccgttaccggtaaacccttaaacggtaaaccggtaacccgttaaccccgaaacggtaacgtaccggttaacggggtaaccggggtaaggggtaccgttacgggtacggtaaccccggggg

SEQ ID NO: 176922 - DNA, 677 bp, Homo sapiens
  misc_feature: GYAE6OF02I6XEQ.10.35.D02.1.454.CMB.1.raw
  modified_base (180)..(180): a, c, t, g, unknown or other
  misc_feature (180)..(180): n is a, c, g, or t
  modified_base (300)..(300): a, c, t, g, unknown or other
  misc_feature (300)..(300): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggatttccttgctgcattttaaaaggtntcagtgtgacgtgcagttggtacggagtcgtggggggagtcgttggttaaggccggggggtccttagactctcctgttcagtcctgtggtattcgagtgtcactaacgcctggactggancgtggtccgccacgtcccgagggagggtcctggagtgggtcgtccttattagagtcgagaccgtgagtggtagggtacaagaggaagtacgagttggacttacggtaaaaggccgaagtacgttaccgacctaatactactaagttcgatgtactacgaaagacgtacgttagtaacgtcgtaaggaagtagagacgtacgtacgtaggaaacgtcggtaatacggaacctacgtaacggtacccgtatttaacgtttacgttacggttaaccgtaaaccgttaaacgggaccgttaacccggaacgtaaaccggttaaccgttacgggtaacgggggtaaaccgggtacccggtacgggtaccggttaccgggggg

SEQ ID NO: 176923 - DNA, 889 bp, Homo sapiens
  misc_feature: GYAE6OF02GU5TD.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttccttgctgactaagttttaaaggtgtccagtgtgacgtgctagttggtggaggtcgtgggggaggtcgttgggttaacggccggggggtcccttaggaccgtcgtccttgttcgacggtccttcgttcggtactttccgtaggttcggtcctaaccttaaaccgtcccgttaggaacgttggacggtcgttacggggttccccggcccgtaaccggttaccccccgggaaggggggaaccggggtccggtacggggtaagggtttcgggggtttacgggttacccgttttaagtttaacgggaacggtaccgtaacgggaacccggttaggtaacggttacggggttaggggaaacccgtaaacgtaacgggtaacggtaaccggtaccggttagggttaaacgtttaaccgggtaaaaagggcgtaaaggtaacctttccccggtacctaacgttaccgttactaaacgtttggtaacgtaaggtaacggttaaacgaaaacggtaaacccgtaacgggtttacgttaacgttaccgttagggtaaaaacgtcgggtaacgtaccggtaacggaccgtaacgggaaacggtaccgtaacgtaacgaccgaaaccgtacggtaaaccgttacgtttaattacgtttacggtaaccctaacgtaaaccggtacgtaacccgtaacgtaacgtagttacggaaggggtacgtacggtcggcggtaccgggg

SEQ ID NO: 176924 - DNA, 830 bp, Homo sapiens
  misc_feature: GYAE6OF02GFC6O.10.35.D02.1.454.CMB.1.raw
tcagcatagtagtgcacgaccggtgctcgatttagcacacgatagttgggtttggggagctctgggagaggagccccagccctgggattcccaagtgtcttcattcagtgatcaggactgaacacagaggactcaccatggagtttgggctgaggtggatttttccttgctgtactaagtttttaaaaggtgtaccagtgtgacgttgcgtaggttggtggagtcggtgggggaggtcgttagggttaacgggcccggggggttcccttaggaccttcgtccgttgttccacgcccgttcgtggtattcgagttcgtaccaacgttaaccgcctggatggtacgtccggttcgggtcccgaccgacggttacccccggaggggaacgggtcgtgggacggtttcgggggttcggtacccgtttaagttaacggaacgtaccgtacggtacccgttggacgttgggtaagggaactaaacggaggtaacggtaccggacgttaagggtaacgttaaaccgggtaaaaacggtccgtaaacgttacggttacccgtaacccgtaacgttcccttaaccgttaaagtttacggtaaagtttaacgggtaaacggttaaacccgaaaaaacggtaacccgttaacccggtttaagtttaaacgtaaccggttaaaggttaaacgtacggaacggtaccgtaacggtccgttaaagggaacgtaccggtaagacgaaccgtaacgacggtacttacgtaacgtttacgtacgtaacctaacgtaacgtaccgtaaccgacgtaagtacggtacggacgggtaaggtacgtacggg

SEQ ID NO: 176925 - DNA, 769 bp, Homo sapiens
  misc_feature: GYAE6OF02IU8K7.10.35.D02.1.454.CMB.1.raw
tcagcatagtagtgcacgaccggtgctcgatttagcacacgatagttgggtttggggagctctgggagaggagccccagccctgggattcccaagtgtcttcattcagtgatcaggactgaacacagaggactcaccatggtagttgggctggaggtggtattttcctgctgactaaagtttaaaggtcgtacctagtcgtgacgtgtcgtaggttggtaggagtcggtgggggagtcgttgggttaacgggtcccggggggttacccttagtaccgttccgttacccgttggttcgacggtacccgttgtaggtacttcgagttcgtacctaaccgtaccgtccgtaggactacggagtccggtcggtcccgaccgtaccggtaccccggaaggggtaacgggtcgtgggtacgggttcgggttcggtacgttagtaaggtaagtccgtaagtaccgtaggtacgttaggggtacggaactaacgtaaggtacggtaacggacggttagtaaacgggtttaacggaaaacgggtcaacggttacgtacccgtaaccgtactacgtacgtaaagttgtaatacgtaacgaacgaaaacgacgttacgtagttagacgtaaggaataggaacgacctaagtacggtaaggaaacgtcgtaaagtacaacgaacgtagtacttagttaactacgtttaacgaaccttaacgtaaagaccgtaacccggtaaagtaccggttaactaggggtaacgggtacgtacggtacgg

SEQ ID NO: 176926 - DNA, 573 bp, Homo sapiens
  misc_feature: GYAE6OF02HTCV8.10.35.D02.1.454.CMB.1.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (561)..(561): a, c, t, g, unknown or other
  misc_feature (561)..(561): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctccagaaaccaccggagaagttgtgttgacgcagtctccaggcacctgtcttgctcagggaaangccacctctcctgcaggccagtcactatgttagtcgactaactacttagccttggttncagcacaaaccgtggccaggcctccgagcctcncatctatgctgcncttccatcgaggccacgtgcatcccgagcagcttcgagtcgagnggtcggtngggactagactcactctcgaacntcacgcgaacgactacggacgcgtagtaagtntttacgngtacgtactttaacgttacgtacgtcgtagtacgtacgttaagtcggtacctaccgttaaccgttaacggttaccgtttacggccggtaacggtaccaggtacgtaggtaacggtactaacgaaacgtacgtgtcggtacgtacgtacnccgtagttaccg

SEQ ID NO: 176927 - DNA, 676 bp, Homo sapiens
  misc_feature: GYAE6OF02JE3CC.10.35.D02.1.454.CMB.1.raw
  modified_base (311)..(311): a, c, t, g, unknown or other
  misc_feature (311)..(311): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgctaattttaaaggtgtccagtgtgacgtgcagttggtggagtcgtgggggagtcgttggtaaggccggggggttcccttagacctctcctgttcacgccttgtggattcagttgtcactacgccgtgatgagcgtcgggtcccnccgacgtccccgaggggacgggctaggacggttggggtacggtccttagttaacggacgtcgtaacgtaccgtggagttcgggtaggaacgtaacgaggaacggtacgcggtacggtaagtttaacggaaaaggctagtacgttcgacacgttctacgaatttagacgtgtaaggtacaaacgtaacacgttgtactgtacggaaatcgataccgagtaccgttaaggaacgtgaaccgttagaacccgtaagacggttacctagtttaagtttactacgtaacgtaaccgttaagtaacccgtacccaaggttaacccaggttacgggtaagggaaccgggtaacttgggaaccggtacggggg

SEQ ID NO: 176928 - DNA, 827 bp, Homo sapiens
  misc_feature: GYAE6OF02I9DMR.10.35.D02.1.454.CMB.1.raw
  modified_base (121)..(121): a, c, t, g, unknown or other
  misc_feature (121)..(121): n is a, c, g, or t
  modified_base (581)..(581): a, c, t, g, unknown or other
  misc_feature (581)..(581): n is a, c, g, or t
  modified_base (612)..(612): a, c, t, g, unknown or other
  misc_feature (612)..(612): n is a, c, g, or t
tcagcatagtagtgcacgaccggtgctcgatttagcacacgatagttggggtttggggctgggagaggagccccagccctgggattcccaagtgtcttcattcagtgatcaggactgaacncagagctcaccatggagttggctgaggtgtattttcctgtctgtactaagttttaaaggtcgtcctagtgtgacggtgtacgtaggttgggtaggtaggttcgggtaggggggtacggtccggtttacggggttaacggggtcccgggggggttacccttaacggtaccttcgttcccgttgttaccgacggtcccttcgttcggtacgtttacgtacggttcgttaccgtaaccgttaaccggtccgtacggtagtcggaacggttccggtaccgggttccccaaccggtaccggtaacccccgggagggggtaacggggtccggttacggggtacggggttacgggtttacggtaccgttttaaggttaacggacgttacggtacgtaccggtagtacggtagggtaccggaactacggtagtacggtacgtacgtacggttaagtaacgtaaacggngtaacggtcgtaccgtaccaattcccgtaanatttaggactagtataacgaactacgtacttaagtctacgtaagattacgaggtacgttacgacggttaaagagtacgtaaaggaccgtaaagacgttacggtaacttaacgtttcgttaacttacgaacgtttaaacgtaacccggaacgtacccgtaaagccccgggttaaggttcgggttaaccggaggtaccgtacgggttcgggaacggg

SEQ ID NO: 176929 - DNA, 759 bp, Homo sapiens
  misc_feature: GYAE6OF02JMJAA.10.35.D02.1.454.CMB.1.raw
tcagcatagtagtgcacgaccggtgctcgatttagcacacgatagttgggtttgggagctctgggagaggagccccagccctgggattcccaagtgtcttcattcagtgatcaggactgaacacagaggactcaccatggagtttgggctgaggtggattttcctgctgctaatttaaaaggtgtccagtgtgacgtgcagttggtggagtcgtggggaggtcgttggttaacggccggggggtccttaggacgtccgttccgtgttcgagtccgtctggattcgagtgttccactaaccgcttggatgagcgtcggtccgccacgtcccgaggggtacgggcttgggaacggtgggttcggccgtttaagtacggtaacgcgacggtaccgtggaagtgggtcgggaactaacgaggtacgtacgattagggattaacgggtaaaaggcctaaggtaccttacggtacctacgttaccggttaaccgtaaacgtttgtaaagttacggtaaacgggttaaactaaaaaccggtaaaccgttaaaccggttaaacgttaacgtttaacgtaaacgggttaaaaagtccgggaaacgtaccggttaacggtaccgtaaagggttaaaacgaccgggtaaacgtttacggaaacccgtaacgtaacgggtaaccgttaccgttaaagtttacgttaacggtaccgtaacgtaagtacccgttacaacggtaagacgttacggaacgggtacgtactacggg

SEQ ID NO: 176930 - DNA, 622 bp, Homo sapiens
  misc_feature: GYAE6OF02IBM7I.10.35.D02.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
tcagcatagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttangacaactacttagcctggttncagccacaaacctggccaggcctccgaggctcctacatctatcgctacgctactcccattcgacgggtccagtcggacacgtacccggagacagtattcgaggtcggcgtagggttcgggtacgtagggacctacgtaccttcaacccgttccgacctaccgtacgtcacggtacgacgagttacggactccgtaagacgttcgttgtactacgttacctagttacgtacgaccgtagcttaaggtcgtacgtacgtaacccgtaccttaaggtaccgttcggaccggtaacggcctaaggtcggtagtaccgtacgtaacgtaacgtacgtggtacgtacgtacggaccttaacgtcgttaacg

SEQ ID NO: 176931 - DNA, 768 bp, Homo sapiens
  misc_feature: GYAE6OF02H8KRS.10.35.D02.1.454.CMB.1.raw
  modified_base (767)..(767): a, c, t, g, unknown or other
  misc_feature (767)..(767): n is a, c, g, or t
tcagcatagtagtgcacgaccggtgctcgatttagcacacgatagttggggtttgggggggtcccttagactctcctgttcagcctctggattcagtgtcactaacgcctggatgagctgggtccgccagtccccgaggggaaggggcgtggagtgggttggccttattagaagcagacctgatggtagggacaacagagtacgcgtggattacggtaaaaggcaagtacttcgccatctacaaattgatggaagtacaaaagaacaccgtgtatcgtaggaaatgaagcagtcctagggaaagcgaatacgaacagacggaccttagtaatttattacggtaaccaataaggtaaccgtccaaacggaacgaacgttaggtaaggggaacgggtactcggtcggtacgggggacccgaagggggtaccgtcccggtttacgtaccgtaacccggttcttacccgtaccgaccggtacccctacccggaaacccgtaacggggcccctacggttcccggtccctttcccccggtcgggccccgtccccgtacgtcccgtacccgacgggacccgaccgtaacccggtaccgaacgaacggtccgaaccgaccggggcccgtcccgggaccgggtccctccgggtacccggtacgggttaaccgaaacccggtaacccgttaacccgttacccaacccgtacgttaacgtccgtacgtacggacgggtaccggtacggtccggaacggacggtccggacgacgtacgnc

SEQ ID NO: 176932 - DNA, 980 bp, Homo sapiens
  misc_feature: GYAE6OF02GRJVY.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtgtattttccttgctgctaattttaaaggtgtccagtgtgacgtgcgtaggttggtggagtcggtgggggtaggtcgtttacggggttaacgggtccggggggggttccctttacggaccgttccgttacccgttcggtttaccgacggtccccgtttcgtcgggtaacgtttccgaggttcgttccgtaaccgttaaccggtcccgttaggtagtacggaaccggttccggtcggggttccccggacccgaacgggttacccccccggaaaggggggtaaaccgggggtccgggttacggggtacgggggtttcgggggttttaccgggtttacccgtttaaaggtttacgggtaaaaccgggtaccgaaaccggggtttaacccgttggggttaaaccgggttgggggttaaccggggaaaacccgtaaacgggtaaccggggtaacggggtttaacccggtaccggttttaacggggtaaacgggtttaaaccggggtttaaaaaaaccggggcccggtaaaaggtttaaccggtttacccggtaccgttaaacggtttcccgttaaccggttaaacgttacgggtaagttacggtaaacggtaacgtaaaacggtaaacccgtaaccggttagttaaccgtttaccgtaacgggtaaacgttcggtaaacgacgttaacggtaccgtaaagggtaaagtacccgtaagtacgaaccaacgtacgtacgtaacgttagttacgtacgaaccgttaaacgacgtacccggtaacctacggtaacgtacgtaacgggtagggtaacgacgtacggttccggaacgggg

SEQ ID NO: 176933 - DNA, 880 bp, Homo sapiens
  misc_feature: GYAE6OF02H9Q8Y.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcgaggactgaacacagaggactcaccagtggtagtttgggactggaggttggtatttttcttgctagtacttaaagttttaaaaggtgtcgtagtgtagacgtgcgtaggttgggtggtaggtcgggtgggggtaggtcggtttaggggttaacggggcccggggggtttacccttaggtaccttccgttccgttcggttaccacgccgttacgtggttacttcgtagttcgtacctaaccgtaaccgtccgtaggacgtggacggtcggtccggggtccccgaccggacccgggtaaccccgggaaggggggtaacggggtacgtgggggtaagggtttcggggtccggttacgtttaagtaacggaacgtacgaacggtaccgtggttacggtacgggtaaggaaaccgtaaaggaggtaacggtacgtcgtaaggttacgttaaagaaacggtctagttacctaccgtacttacgtcgttaactaacgttagacggttaagtaacgtaaactaaaacggtaccgttaacggttaacgttaacgtttacgtaaagggtaactaacgggacgtaaccggtacggtaacggtaacggggtaaactacgggtacgtaacggtaaaccgaacggttacggttaaacctttacgtttaacggttactaacccggttaaacggaacggttaaaccgaccggtaaacccgttaagaacggtttacgggaacgggtaaccgggaacggttcggttaccgggagggttaaccccggggg

SEQ ID NO: 176934 - DNA, 654 bp, Homo sapiens
  misc_feature: GYAE6OF02FWEMC.10.35.D02.1.454.CMB.1.raw
  modified_base (527)..(527): a, c, t, g, unknown or other
  misc_feature (527)..(527): n is a, c, g, or t
  modified_base (621)..(621): a, c, t, g, unknown or other
  misc_feature (621)..(621): n is a, c, g, or t
  modified_base (641)..(641): a, c, t, g, unknown or other
  misc_feature (641)..(641): n is a, c, g, or t
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaagttttaaaaggtgtaccagtgtgacgtgctagttggtggagtcgtgggggagtcgttggttaacggccggggggtcctagactctccgtgtcagcctcgtggattcgagtcgtcacgtaacgcgtaggatgagtcgtcggccgccgtacgccccggaaggggacgggcgtgggtaggtggggttacgtccgttaagtagaacgcgagtaccgtagtaggtcgggtaggaacaacggaggtacgtacggtcgtaggtaacgttacgaaaggtcgaagtctaccgactatacgtactaagtcgatacgaagtaaccaaacggtaaccaccggttagtactacggtaagtaagtgaacgngtaacggacctaaagggaacgcgtaacgacgaacgtaacgacgtacttactaagtttactacgaaccgttagaacgtacgtacccgaacgtaanacggtgggaacggacggtcncggtacgtacggg

SEQ ID NO: 176935 - DNA, 850 bp, Homo sapiens
  misc_feature: GYAE6OF02HN1K1.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggtattttccttgctgtactaagttttaaaaggtgtcctagtgtgacgtgcgtaggttgggtggagtcggtgggggaggtcgttgggttaacgggtcccgggggggttcccttaggtaccttcgttccgttgttccgacgtcctcgtggtacttcgagttgtaccaacgtaaccgtccgtaggtatggaggcggttcgggtccccgacccgtacccggtaccccccgggaaggggggaacgggggtccgtagggggtacgggtttcggggtttcgggtacccgttttaaggttaacggaacggaccgtaacggtaaaccgttgggtaaggttacggggtacggggaaacctaaacggtaagggtaaccggtacggtacggttaagggttaacgttaaacgggttaaaaggacgttaagtaccggttaccgtaccctaacgttaccttacgtaagtttaggtagttaggtaaacgtaacgaaaacggtaacccgtaacgttaacgtacgttacggtaaacggtaaaacgtggtaaacgaccggtacgtaccggtaaccggaaaggtccgaagtcgtaacgtacgaacggtaacttattaccgttagttaacctaaccgtaagttaaaccgaccgtaaccgaaacggtacgtacggttacggggtaaccggggtaaggtactacgggtcggtacccgggg

SEQ ID NO: 176936 - DNA, 761 bp, Homo sapiens
  misc_feature: GYAE6OF02JVMCW.10.35.D02.1.454.CMB.1.raw
tcagcatagtagtgcacgaccggtgctcgatttagcacacgatagttgggtttggggagctctgggagaggagccccagccctgggattcccaagtgtcttcattcagtgatcaggactgaacacagaggactcaccatggagttgggctgaggtgtattttcctgctgctaagtttaaaggtgtccagtgtgacgtgctaggttggtggagtcggtgggggagtcttagggttacgggccggggggttaccttaggaccttcgttccgttggttccgacgtccgttcgtaggtacttcgtaggtacgtccaacgtaaccgcgtggagtgacgtcgttccggcccgccacggtcccggaagggacgggtcgtcggtaggttcgggtacggtaccgttaagttaaggaacggacgtacgtaccgtaggtacggtacgggttaggaaccgtaacgtacggtacggtacgtccgttaggtaaccgttaacggtaaacggcgtaaggtacttccggactacgttccgtaacgtagttacggaagttacggtaacggtaaccgaaacgtaaccggttacggtaacgttaacgtacggtaaaggtaaacgtggtaaccggagtaaaccgtcgtaaaggtaacgtaccgtaagtaccgaaagaacgtaacggtacttacgttacgttaacgtacggtaacctaacgtaacgttaaccgtaccgaacggtaacgtaccggttaaggtaaccgggacgtacggtaccggg

SEQ ID NO: 176937 - DNA, 607 bp, Homo sapiens
  misc_feature: GYAE6OF02GQ3HQ.10.35.D02.1.454.CMB.1.raw
tcagcatagtagtgcacgaccggtgctcgatttagcacacgatagttgggtttggggagctctgggagaggagccccagccctgggattcccaagtgtcttcattcagtgatcaggactgaacacagaggactcaccatggagtttgggctgaggtggattttccttgctgactaattttaaaaggtgtccagtgtgacgtgcaggttggtggagtcgtgggggaggtcgttgggttaaggcccgggggggttcccttaggactcttcctgttcagcctctggattcagtgtcactaacgcctggatgagctgggtccgccgacgtccccgaggggaggggctggaggtgggttggccttagtagaagcgagaccgtgagtgggtagggacaacgaggagtacggctaggacgttacggtaaaaggcgaagtacgtacgccactctactaattgatacgtagtacaaagaccgtacgtagtactgtagaactgagcgagaccgtagggaacgcgatacgacaacgacgtactcttaattacgtacgtaacgtacgtaacgacgtacccgaacgtaacggtacgtagggtacgggtacggcgtacggg

SEQ ID NO: 176938 - DNA, 742 bp, Homo sapiens
  misc_feature: GYAE6OF02G7J8R.10.35.D02.1.454.CMB.1.raw
tcagcatagtagtgcacgaccggtgctcgatttagcacacgatagttgggtttggggctgggagaggagccccagccctgggattcccaagtgtcttcattcagtgatcaggactgaacacagaggactcaccatggagtttggctgaggtggattttccttgctgctaattttaaaaggtgtccagtgtgacgtgctagttggtggagtcgtgggggagtcgttgggtaacggccggggggttacccttagtaccgtcgttacccgttgttaccacgtcccttcgtaggtacttcgaaggttcgtaccaaccgttaaccggtccccgtaggtattacggaggtccggttcggggtaccccgtcccgaaccggttcccccggaagggggaacggggccggtagggacggtggggttcggtacgtttagttacgagacgtagaccgtgtacgtaggtagggaaccgaacgtaggtacggtacgtcgtacggtaagttaacggtaaacgaccgagttacgttacggcctagtcctactaagttagacgtaggtagtaaaccaaagaaccgtaaccggttagttaacgtacggtaagaacgttagacgacgtacgtccgtaaggaacgtacgatacgactaccggataccgttaattacgttacgtacgtaacgtaacgttaacgacgttacccgacgaagttaacggtacggaacgggtacggaacggtcgtaccggtacgggg

SEQ ID NO: 176939 - DNA, 966 bp, Homo sapiens
  misc_feature: GYAE6OF02I9PVJ.10.35.D02.1.454.CMB.1.raw
  modified_base (937)..(937): a, c, t, g, unknown or other
  misc_feature (937)..(937): n is a, c, g, or t
tcagcatagtagtgcacgaccggtgctcgattagcacacgatagttgggtttggggctgggagaggagccccagccctgggattcccaagtgtctcatcagtgatcaggactcgaacacagaggactcgaccagtggacggtttcggcgtggagggtggtattttccgttggccgttaggtacctaaagtttttaaacgggtcgtacccgtaggttaggtcggtaaccgtggtcgtaaggttgggtacgggacgttaccggtggggggacggtaccgtttaggggttaaacgggccccgggggggtttacccttacgggtaaccgttccggtttccggttccggttacgaacggtcccgttaccggtgggtacttccgtaggttacgtccgtaaacgtaccggtccgtagggtacgtacgttaacgggccgtccgggggttaacccctcccggtacggtaccccgggtaaggggtaccggggaccgttaggggtacgggttacgggtacggtcccggttttaggtaacgggtaacgtaccggtaaccggttacgtcgggttaacgggtacggttaccggggtaaacctaacggtaacgggtaacggtttacccggaccgggtttaagggtaccgttaaaaccggttaaaccggggtcctaaaccgggttacgtaaccccgggttacttaacccgggtaccgttaaaccgttaacttaaaccggggggtctttaaccgggtaaaccgtttaccggggaaaacccgtaaccggttacccggttaaggtaaccggttaacgttaagggtaaccgtacgggtaacgtaaccggcgttaaccgggtaacgggtactaacggggtactaacgggtaaccgtacgtaaaccgggttacctaccgttaggtacttacaacggtaactacgacgtaacacggttancggttagcggtaacgctagggcgtacggg

SEQ ID NO: 176940 - DNA, 679 bp, Homo sapiens
  misc_feature: GYAE6OF02G4MYB.10.35.D02.1.454.CMB.1.raw
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
  modified_base (676)..(676): a, c, t, g, unknown or other
  misc_feature (676)..(676): n is a, c, g, or t
tcagcatagtagtgcacgaccggtgctcgatttagcacacgatagttgggtttggggggtcccttagactctcctgttcagcctctggattcagtgtcactaacgcctggatgagctgggtccgccagtccccagggaagggctggagtgggttggccttagttagaagcagacctgatggtgggactaacgagagtacgctggattacggtaaaaggcagattcgccatctacgaattgatgagtacaaagacaccgtgtatcgaggaaattggagcacggccgtaggaaacgcggaatgaccacgtaggacttacgtatttagtacgtaaccacttaagcgttacccacgaaanccgttaggacgggaaggacctggtacgngggacctacggggactccgtttacgaccgtacgtccgtactacgaccgccttacccgacccgtaagggcccctaacggtcccgtacccttcccccggtacgcccggcccttcgtacccgtccgacgtaccgccacccgtaccgagacgcaaccgcgttcccggccgttcgtacgtccgtacgtcccgtacggtacgtaacggtaacctaccgttacccctagttaccgtcgtttaacgcccggttacggaacggttccgggactaaccgggcgttaacggccggtacttacngac

SEQ ID NO: 176941 - DNA, 713 bp, Homo sapiens
  misc_feature: GYAE6OF02GDFPX.10.35.D02.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
tcagcatagtagtgcacgaccggtgctcgatttagcacacgatagttgggtttggggagctctgggagaggacgccccagcccctgggattcccaagtgtcttcattcagtgatcaggactgaacacagaggactcaccatggagtttgggctgaggtggtattttccgttgtctgctaagttttaaaggtntactagtgngtactgcgagttggtggagttcggtggggacgtgttagggttaacgggcccgggggttcccttaggacttcgtccttgtcacgtccttcgtggtattcgagtcgtacactaaccgtccgtaggattacggagtcgtcgggtcccgccgaccggtaccccggtaaggggacgggcggtagggtaggttccggggtggtccttagttacggagcgaacgtccgtagtaggtcggacggtaacaacggaagtacggtacgtgtacgggtaaacttaacgggtaaacgcgtacggtacgttaccgcctacgttaccgtaacgttacgtagtccttaggtaacgtaacaaaacgtacgttacgtaacgttattaggtagaacgtagactaggaaccgtcgtaagaagcgtacgaacgtacgaacgacttccgtagtttaacgtcgtttacgaacgtaccgtaaacgtaccgtacgtaacggtacgttacggtacggaacgggttacggtccgtacgg

SEQ ID NO: 176942 - DNA, 820 bp, Homo sapiens
  misc_feature: GYAE6OF02FQCFH.10.35.D02.1.454.CMB.1.raw
  modified_base (612)..(612): a, c, t, g, unknown or other
  misc_feature (612)..(612): n is a, c, g, or t
tcagcatagtagtgcacgaccggtgctcgatttagcacacgatagttgggtttggggagctctgggagaggagccccagccctgggattcccaagtgtcttcattcagtgatcaggactgaacacagaggactcacctagtggtagttgggctggaggtggtactttttccgttgcgtgtacttaaagtttttaaaagggtcgttaccgtaggttggtaggtaccggttgtcgtaggtttggggtagggtacggttcgggttaggggggtacggtacgggtttacgggggttaacgggggtccccgggggggggtttaccctttaacggaccttccgttccgttcggttccgacgtcccgttcgttaggtacttcgagttacggtacctaaccgttaaccggtccgtaggacgtcggtacgtccggttacggggtcccacccggtaccggtacccccgggaagggggtaccgggtcgtacggggttagggtcggggttcgtaccgtttagttacggacggtcacggtctaggaggtagggtacggacaaggagtcgtacgtcgttaagacgttaacgggaagtcgattacgtccgactactctactagtagngtacgtacgaacgaacgtacgttacgtagtacgttagtaagtacgtaagtcgaacgtacgtaacggagtaaccgtacgtagtaacgacgtaacgtagttacctttagttacttaacggtacctaacctaacggttaacccggaacccgttaaccggaacggttacgtaacccgggttagggtaacgggtaaccgttcggtaaccgggg

SEQ ID NO: 176943 - DNA, 833 bp, Homo sapiens
  misc_feature: GYAE6OF02JHDRN.10.35.D02.1.454.CMB.1.raw
  modified_base (320)..(320): a, c, t, g, unknown or other
  misc_feature (320)..(320): n is a, c, g, or t
tcagcatagtagtgcacgaccggtgctcgatttagcacacgatagttgggtttggggagctctgggagaggagccccagcccctgggattcccaagtgtcttcattcagtgatcaggactgaacactagaggactcaccatggtagttggctgaggtggtattttcctgctgataatttaaaggtgtaccagtgtgtacgtgtctagttgggtagtagtcggtgggggtaggtccgtttgggttaacggtccgggggggttacccttaggtaccgttacgttccgttagttcgtacgttccgtacgttggtactttacgngttcgtactaccgtaacggccgttggtaaatcgtaacggccgttacgggtacccgtccgtaacggttaccccgggaaggggtaaccggggtcgttacgggtagggttcgggttacggtaccgtttagttacggagtccgtaaggtacccgttaggtacgggttggtacggggtaactaacggtaacggtcggtacgtacggtaggtttaacgttaacggtaaacggacgtacggtaacgtttccgggacctttaacgtccgttaacgtaacgttagtaacgttacgggtaactacggtaaaaccggtcgtaacccggttagttaacgttccgaaaggttaacgtaccgggttacaccggttaacgaccggtaacggggtaaccctacgggtaactacggtaccgtaaacggttcgtaggtttaacccttagttaaccgaccggtttaaacgattaccgggttaaccacggttacctaagggttccgtagggtaacggttacggcgttaccggg

SEQ ID NO: 176944 - DNA, 818 bp, Homo sapiens
  misc_feature: GYAE6OF02HAR1U.10.35.D02.1.454.CMB.1.raw
  modified_base (278)..(278): a, c, t, g, unknown or other
  misc_feature (278)..(278): n is a, c, g, or t
tcagcatagtagtgcacgaccggtgctcgatttagcacacgatagttgggtttggggggtcccgttagactctcctgttcagcctctggattcagtgtcactaacgcctggatgagctgggtccgccagtccccagggagggcgtggagtgggttggccttagttagaagcagacctgatggtaggacaacgtaggagtacgctggattacgaaaggcagattccgcatctactaattgatagagtacaaagacctacgtgtactctagtaaatgaancagaccgtaggaaagcgtaagtcgaacaacgtacggtaccttcgttaactttagttaccgtaaaccaacgttaaagaccgtaacccgaacggtaacggacgttagggtaacggggaaacgggtacttacgggacggtcggggtacccggtaacggggtacggttccccgttagtaccccgtaccggttccttcccgtactacggtcccgttaacccgacccgaaaccgggtccccgtaacgttcccggtacccgtttacccccggcgggtcccggtacccgtcgtacccgtcccggtaacgggcctacccggtaccgtacccggacgaccggaccgtaacggcccgggttacccgaccccgggtccgcccgggttacccggtccggtaccggttaacgaaacccggttaaccgtttaccccgttaacccgtacccgtttaaccgtacggttccggtacggtaccggtaaccgggtccgggaccggttaccgggtaccgggaacggtaccccggtaacggttacccgtaaggtcccgaacg

SEQ ID NO: 176945 - DNA, 448 bp, Homo sapiens
  misc_feature: GYAE6OF01C7CZE.37.78.H01.1.454.CMB.1.raw
  modified_base (447)..(448): a, c, t, g, unknown or other
  misc_feature (447)..(448): n is a, c, g, or t
tcagtagtgtagatcacgaccggtgctcgatttagtgtgagtagtttgggtttgggggctttgtctgggtctcctggacagtcgatcaccatcccctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctggcaacacggcctccctgaccatctctgggctccaggctgacgacgaggctcactattattgcagctcatatacaaagcagcaatcacttgggtgttcggcggaggaccgacctgaccgtcttaggtcagcccaaggctgccccctcggtcactctgttcccaccctcctcatctacactactgagcgggctggcaaggcgcatagnn

SEQ ID NO: 176946 - DNA, 470 bp, Homo sapiens
  misc_feature: GYAE6OF01CT66D.37.78.H01.1.454.CMB.1.raw
  modified_base (386)..(386): a, c, t, g, unknown or other
  misc_feature (386)..(386): n is a, c, g, or t
  modified_base (451)..(470): a, c, t, g, unknown or other
  misc_feature (451)..(470): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgccctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggcccaacccnctgtcactctgttccccaccctcctcatcctacacctactgacgcgggctggcaaggcgcatagnnnnnnnnnnnnnnnnnnnn

SEQ ID NO: 176947 - DNA, 454 bp, Homo sapiens
  misc_feature: GYAE6OF01BXP4P.37.78.H01.1.454.CMB.1.raw
  modified_base (432)..(432): a, c, t, g, unknown or other
  misc_feature (432)..(432): n is a, c, g, or t
  modified_base (448)..(454): a, c, t, g, unknown or other
  misc_feature (448)..(454): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttctctcgcttctctgcctccaagtctggcaacacggcctccttgaccatctctgggctccagactgaggacgaggctgattattactgcagttcatatagaggcgaccacacttatgtcttcgggaagtgggaccaaggtcgtcgtcctaagtcacgcccaaggcccaaaccccatgtcactctcgtccccacctcctcatctacactactgagcgggntggcaaggcgcatagnnnnnnn

SEQ ID NO: 176948 - DNA, 504 bp, Homo sapiens
  misc_feature: GYAE6OF01DGJLE.37.78.H01.1.454.CMB.1.raw
  modified_base (477)..(504): a, c, t, g, unknown or other
  misc_feature (477)..(504): n is a, c, g, or t
tcagtagtgtagatcacgaccggtgctcgatttagtgtgagtagtttgggtttgggggcgtttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttctctcgcttctctgcctccaagtctggcaacacggcctctgaccatctctgggctccagactgaggacgaggctgattattactgcagttcatatagaggcaccacacttatgtcgttcggaagtcgggaccaaggtctcgtcctaagtcacgcccaaggcccaacccactgtccacttcctcgttccccgcccttccgtcacgttcctaacgtacgtaaccgtggacgcgggtctcgggctaaacgggcgacaagtagctnnnnnnnnnnnnnnnnnnnnnnnnnnnn

SEQ ID NO: 176949 - DNA, 480 bp, Homo sapiens
  misc_feature: GYAE6OF01BO8FE.37.78.H01.1.454.CMB.1.raw
  modified_base (453)..(480): a, c, t, g, unknown or other
  misc_feature (453)..(480): n is a, c, g, or t
tcagtagtgtagatcacgaccggtgctcgatttagtgtgagtagtttggggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttctctcgcttctctgcctccaagtctggcaacacggcctccttgaccatctctgggctccagactgaggacgaggctgattattactgcagttcattatagaggcgaccacacttatgtcttcggaagtgggaccaaggtcgtcgtcctaagtcacgcccaaggcccaaccccatcgtcactctcgttcccgccctcctcactcctacactactgacgcgggctggcaaggcgcatagnnnnnnnnnnnnnnnnnnnnnnnnnnnn

SEQ ID NO: 176950 - DNA, 460 bp, Homo sapiens
  misc_feature: GYAE6OF01DZNPI.37.78.H01.1.454.CMB.1.raw
  modified_base (450)..(460): a, c, t, g, unknown or other
  misc_feature (450)..(460): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccaacctgaggacgaggctcactattattgcagctcatatacaagcagcgtcacttgggtgttcggcggagggaccgaccgtgaccgtcttaggtcagccaaaggcctgccccctggtcactctcgttccccgccctcctcactcctacctactgacgcgggctggcaggcgcatagnnnnnnnnnnn

SEQ ID NO: 176951 - DNA, 463 bp, Homo sapiens
  misc_feature: GYAE6OF01B3G00.37.78.H01.1.454.CMB.1.raw
  modified_base (388)..(388): a, c, t, g, unknown or other
  misc_feature (388)..(388): n is a, c, g, or t
  modified_base (449)..(463): a, c, t, g, unknown or other
  misc_feature (449)..(463): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtggggacaaaggtcgtcgtcctaagtcagcccaaggcccaaaccccntgtcactctcgttcccaccctcctcatctacactactgagcgggctggcaaggcgcatagnnnnnnnnnnnnnnn

SEQ ID NO: 176952 - DNA, 451 bp, Homo sapiens
  misc_feature: GYAE6OF01B2LMA.37.78.H01.1.454.CMB.1.raw
  modified_base (384)..(384): a, c, t, g, unknown or other
  misc_feature (384)..(384): n is a, c, g, or t
  modified_base (444)..(451): a, c, t, g, unknown or other
  misc_feature (444)..(451): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggacaaggtcgtcgtcctaagtcagcccaaggcccaacccntgtcactctcgttcccaccctcctcatctacactactgagcggctggcaaggcgcatagnnnnnnnn

SEQ ID NO: 176953 - DNA, 475 bp, Homo sapiens
  misc_feature: GYAE6OF01DMAWP.37.78.H01.1.454.CMB.1.raw
  modified_base (310)..(310): a, c, t, g, unknown or other
  misc_feature (310)..(310): n is a, c, g, or t
  modified_base (450)..(475): a, c, t, g, unknown or other
  misc_feature (450)..(475): n is a, c, g, or t
tcagtagtgtagatcacgaccggtgctcgatttagtgtgagtagtttgggtttgggggctttgtctgggtctcctggacagtcgatcacccatcccctgcactggaacctagtagtgacgttgatgattatgactatgtctcctggtttcaacaacacccagacaaagcccccaaactcatcatttttgaggtcactaatcggccctcaggatttcttctcgcttctctgcctcaagtctggcaacacggcctccttgaccatctctgggctccagactgaggacgaggctgattattactgcagttaanatagaggcgaccacacttatgtcttcggaagtgggaccaaggtcgtacgtcctaagtcagccctaaggcccaaccccatgtccactctcgttccccgcctcctcatctaccactactgagcggctggcaaggcgcatagnnnnnnnnnnnnnnnnnnnnnnnnnn

SEQ ID NO: 176954 - DNA, 485 bp, Homo sapiens
  misc_feature: GYAE6OF01B5005.37.78.H01.1.454.CMB.1.raw
  modified_base (460)..(460): a, c, t, g, unknown or other
  misc_feature (460)..(460): n is a, c, g, or t
  modified_base (466)..(485): a, c, t, g, unknown or other
  misc_feature (466)..(485): n is a, c, g, or t
tcagtagtgtagatcacgaccggtgctcgatttagtgtgagtagtttgggtttgggggcgtttgtctgggtctcctggacagtcgatcaccatcccctgcactggaaccagcagtgacgttggtggttataaatatgtctcttggtaccaacatcaccaacatcacccaggcaaagtccccaaactcatgatttatgaggtcactaaacggccctcaggggtctctaatcgcttctctggctccaagtctggcaacacggcctccctgaccatctctgggctccaggctgacgcgaggctcactattattgcagctcatatacaagcagcatcacgttgggtgttcgggcggagggaccgacctgaccgtcttaggtcagcccaaggcctcgccccctcggtcacgtctcgttccccacccgtcctcacttcctacactactgagcgggctggcaaggcncatagnnnnnnnnnnnnnnnnnnnn

SEQ ID NO: 176955 - DNA, 704 bp, Homo sapiens
  misc_feature: GYAE6OF01BE1F6.37.78.H01.1.454.CMB.1.raw
  modified_base (339)..(339): a, c, t, g, unknown or other
  misc_feature (339)..(339): n is a, c, g, or t
  modified_base (654)..(654): a, c, t, g, unknown or other
  misc_feature (654)..(654): n is a, c, g, or t
  modified_base (660)..(660): a, c, t, g, unknown or other
  misc_feature (660)..(660): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
tcagtagtgtagatcacgaccggtgctcgatttagtgtgagtagtttgggtttgggggtctttgtctgggtctccgtggacagtcgactcaccagtcccctgccacgtggaaccagtagtgacggttgagtcgattatggactagtcgtcgtcctcggtttcaaccaacacccagacaaacgcccccaaactcagtcactttttcgaggtcactaatcggtccctcgagggtatttcgttctcgcttctctggccgtccaaggtctggactaacgacggtcctccttgaccatcgtcgtcgggtcctccagactggaggacgaggactggattattacngactagttcatagtagacggtccgacactacttagtcgttccttacggaaggtgggaccgtaaggttccgttacggtacccgtaaaggttccgaacggtacccgaaacgggtaccccgtaaacccccgttagttacggttccgtaaccgtttccgttaccggtttacccccgaaccccgtttcccttacttaacgtttccgttaaaccgttacgttaaccgttggtaacgggttccgggtaccgttacgggacgtaacgggtccggaccggtaacgttacggaccgtcggacgagtaacgtcgtcgtacgcgtcncgtacncctacgacgtcgctcgtcgtcctccgctctacctacncngcgcg

SEQ ID NO: 176956 - DNA, 463 bp, Homo sapiens
  misc_feature: GYAE6OF01A4UQM.37.78.H01.1.454.CMB.1.raw
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (450)..(463): a, c, t, g, unknown or other
  misc_feature (450)..(463): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggccaaaccccnctcgtcactctcgttcccaccctcctcatcctacactacngagcgggctggcaaggcgcatagnnnnnnnnnnnnnn

SEQ ID NO: 176957 - DNA, 477 bp, Homo sapiens
  misc_feature: GYAE6OF01DGOMM.37.78.H01.1.454.CMB.1.raw
  modified_base (301)..(301): a, c, t, g, unknown or other
  misc_feature (301)..(301): n is a, c, g, or t
  modified_base (459)..(477): a, c, t, g, unknown or other
  misc_feature (459)..(477): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattacngcagttcatatagaggcaccacacttatgtcttcggaagtggggaaccaaggtcgtcgtcctaaaggtcacgcccaaggcccaaaccccatgtccactctcgttcccgccctcctcatctacactactgaacgcgggctggacaagggcacagtacgnnnnnnnnnnnnnnnnnnn

SEQ ID NO: 176958 - DNA, 471 bp, Homo sapiens
  misc_feature: GYAE6OF01DXBKE.37.78.H01.1.454.CMB.1.raw
  modified_base (300)..(300): a, c, t, g, unknown or other
  misc_feature (300)..(300): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (454)..(471): a, c, t, g, unknown or other
  misc_feature (454)..(471): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaattttcttctcgctttctctgcctccaagtctggcaacacggcctctgaccatctctggctccagactgaggacgaggctgattattacngcagttcatatagaggcgaccacacttatgtcttcgggaagtggggaccaaggtcgtcgtcctaagtcagcccaaggcccaaacccnctgtcactctcgttccccnccctcctcactcctaacactacncgagcgggctggcaaggcncatagnnnnnnnnnnnnnnnnnn

SEQ ID NO: 176959 - DNA, 460 bp, Homo sapiens
  misc_feature: GYAE6OF01BNO9V.37.78.H01.1.454.CMB.1.raw
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
  modified_base (446)..(460): a, c, t, g, unknown or other
  misc_feature (446)..(460): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcaccanacttatgtcttcggaagtgggaccaaggtcgtcgtcctaagtcagcccaaggcccaaccccntgtcactctcgttcccgccctcctcactcctacactactgagcggcnggcaggcgcatagnnnnnnnnnnnnnnn

SEQ ID NO: 176960 - DNA, 453 bp, Homo sapiens
  misc_feature: GYAE6OF01BA5B4.37.78.H01.1.454.CMB.1.raw
  modified_base (246)..(246): a, c, t, g, unknown or other
  misc_feature (246)..(246): n is a, c, g, or t
  modified_base (441)..(441): a, c, t, g, unknown or other
  misc_feature (441)..(441): n is a, c, g, or t
  modified_base (446)..(453): a, c, t, g, unknown or other
  misc_feature (446)..(453): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaatcatcatttttgaggtcactaatcggccctcaggaatttcttctcgcttctctgcctccaagtctggcaacncggcctccttgaccatctctgggctccagactgaggacgaggctgattatactgcagttcatatagaggcgaccacacttatgtcttcggaagtgggaccaaggtcgtcgtcctaagtcagcccaaggcccaaccccatgtcactctcgttccccgccctcctcatctacactactgacgcgggctggcaaggcncatgnnnnnnnn

SEQ ID NO: 176961 - DNA, 458 bp, Homo sapiens
  misc_feature: GYAE6OF01APUS0.37.78.H01.1.454.CMB.1.raw
  modified_base (448)..(448): a, c, t, g, unknown or other
  misc_feature (448)..(448): n is a, c, g, or t
  modified_base (453)..(458): a, c, t, g, unknown or other
  misc_feature (453)..(458): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattacctgcagttcatatagaggcgaccacacttatgtcttcgggaagtgggacccaaggtcgtcgtcctaagtcagcccaaggcccaaaccccactgtcactctcgttcccaccctcctcactctacactactgacgcggctggcaaggccnatagnnnnnn

SEQ ID NO: 176962 - DNA, 527 bp, Homo sapiens
  misc_feature: GYAE6OF01BOMFZ.37.78.H01.1.454.CMB.1.raw
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (496)..(497): a, c, t, g, unknown or other
  misc_feature (496)..(497): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (515)..(520): a, c, t, g, unknown or other
  misc_feature (515)..(520): n is a, c, g, or t
  modified_base (522)..(527): a, c, t, g, unknown or other
  misc_feature (522)..(527): n is a, c, g, or t
tcagtagtgtagatcacgaccggtgctcgatttagtgtgagtagtttggggtttggggggctttgtctgggtctctggacagtcgatcacatccctcgcactggaaccagttagtgtacgttgatgtattatgactatgtctcctggtttcaacaacaccagacaaagccccaaactcatctatttttgaggtccactaatcggcctcaggaagtttctctcgcttctctgcctccaagtctggcaacacggcctccttgacatctctggctccagactgagacgaggctgattattactgccagtttcactataggacggcgaaccactacttatggttacttcggaagtcgggaccaaggtcgtcgtccgtaagtcgacgccaacggtccctaaacccatcgtactacttcgtcgttccccnccctctacacttcctaacncttactggacgtccgggttntcggcgaaggtccgataatagctgacntcgncnncgcngtactagananagnnnnnncnnnnnn

SEQ ID NO: 176963 - DNA, 713 bp, Homo sapiens
  misc_feature: GYAE6OF01CO747.37.78.H01.1.454.CMB.1.raw
  modified_base (631)..(631): a, c, t, g, unknown or other
  misc_feature (631)..(631): n is a, c, g, or t
  modified_base (703)..(703): a, c, t, g, unknown or other
  misc_feature (703)..(703): n is a, c, g, or t
tcagtagtgtagatcacgaccggtgctcgatttagtgtgagtagtttgggttggggggctttgtactgggtctcctggacagtcgatcaccatcccctgcactggaaccgacgtagtgacgttgatgagttatgactatgtctcctggttcaacaacacccagacaagccccaaatcatcattttgacgtcactaatcggccctcaggtaatttctctcgcttctacgtgcctccaagtctaggaccaaacaccggtccttccgtacggaccctaatcctacgtcgggaccttccgaagtaaccgttggaacgggaccgtagggtccttaggaactttaacgtaaccgtgggacctaacggtttccaaattactacggacgggacctaaccctactacctttagtcgttaccgtttaccgggaaggttacggggaaccctaagggtccggttacccgtaccgtaaaggttcccgaacggacccggaacgggtacccctaaaccccgtacgttcgtacccaccgttaccgtaccgtttaccccccaccctttcccctactactttacctaaccgtacttaacgtcggaacggtccggggtactacgggacctaacgggctaacgagttacgntactagtacacgtataacgtatacgatccgtcgtactactacgtacgtagacgtcgacgagacgtacacganacgtgtgtag

SEQ ID NO: 176964 - DNA, 456 bp, Homo sapiens
  misc_feature: GYAE6OF01CEJCM.37.78.H01.1.454.CMB.1.raw
  modified_base (418)..(418): a, c, t, g, unknown or other
  misc_feature (418)..(418): n is a, c, g, or t
  modified_base (446)..(456): a, c, t, g, unknown or other
  misc_feature (446)..(456): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccaggctgaggacgaggctgattattactgcagttcatatagaggcgaccacacttatgtcttcggaagtgggaccaaggtcgtcgtcctaagtcagcccaaggccaaaccccatcgtcactctgttcccgccctcctcatctacnctactgagcggctggcaaggcgcatagnnnnnnnnnnn

SEQ ID NO: 176965 - DNA, 651 bp, Homo sapiens
  misc_feature: GYAE6OF01CK69W.37.78.H01.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
tcagtagtgtagatcacgaccggtgctcgatttagtgtgagtagtttgggtttggggggctttgtctgggtctacctggacagtcgatcacatccctgcactggaaccagtagtgacgttgatgattatgactagtgtctcctggtttcgaacaacacccagactaaacgcccccaaatcatcatttttgaggtcactaatcggccctagaggtaatttcgtcncgcttctctgcctcaagtctggacaacncggcctccgtgaccatctcgtggctccagactgagacgngctagtcttatcngcctgcctnatacgngacgtaggtacgtcctacctcttaancggttacttacggggactcgggggtaactaagggtccaaccggttcctaaaggtcccaacggacccctaaaggaccccctaaaccccgtattacgtacctaaccttcgtaccgttaccccctacccttacctactaacctacctaacctacctttacgtacgtacggtccgggtactacgggtacaacgggaccgtactaaccgtaacgcgtacgtagtactagtaccgtagtaccggactagtaccgagtacgtaacgtacgtacgtagtaccgtagtaccgtacgacgttcacgttcgtcgtac

SEQ ID NO: 176966 - DNA, 461 bp, Homo sapiens
  misc_feature: GYAE6OF01BSOCI.37.78.H01.1.454.CMB.1.raw
  modified_base (389)..(389): a, c, t, g, unknown or other
  misc_feature (389)..(389): n is a, c, g, or t
  modified_base (450)..(461): a, c, t, g, unknown or other
  misc_feature (450)..(461): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcgggaagtgggaccaagggtcgtcgtcctaagtcagcccaaggcccaaaccccntgtcactctgttccccgccctcctcatcctacactactgagcggctggcaaggcgcatagnnnnnnnnnnnn

SEQ ID NO: 176967 - DNA, 451 bp, Homo sapiens
  misc_feature: GYAE6OF01EP953.37.78.H01.1.454.CMB.1.raw
  modified_base (444)..(451): a, c, t, g, unknown or other
  misc_feature (444)..(451): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctctagactgaggacgaggctgattattactgcagttcatatagaggcgaccacacttatgtcttcggaagtgggaccaaggtcgtcgtcctaagtcagcccaaggcccaaccccatgtcactctcgtcccgccctcctcatctacactactgagcggctggcaggcgcatagnnnnnnnn

SEQ ID NO: 176968 - DNA, 785 bp, Homo sapiens
  misc_feature: GYAE6OF01EB29U.37.78.H01.1.454.CMB.1.raw
tcagtagtgtagatcacgaccggtgctcgattttagtgtgagtagtttgggtttgggggggcgtttgtctggggtcgtcctggacagttcgagtacaccatcctcctggccacgtcggaacccagcacgttccgaccgtttggtggtttataaatatgtctcttggtaccaacactcacaacatcacccagcaaagtccccaaactcataatttatgacggtcaactaaacggccctagaggtacgtttcctaatccgctttcgtactggtccttaccaaggtcctaaggactaactacggtccttcccgtgaaccatctactgggcctcccaaccgtcgaggacgaggctcactattatgcagctacatactacgaagccaagcgtactacgtttgggtgttccggcggacgggacccgaccgttcggaacccggttcgttaacgggtccaaccggtcccccgtaaaggggtcccttaccggtaccccccccgttcgggggttacccgtaacccgtttcccggtttaccgggtttaccccccctaaccccgtttaccccgttaccgtaaccgtttaccgttaaaccccttaaccgtttaaccgttttacgggaaccgggtccccggggtaccgttacggggaacccgtaaacggggtccggttaacgtaacgttacggacgtgggttacgcggacgacgtaacgtgtacgtccgtccgttaggcccgtacgacgtcgtccgtcccgtacccgtaccgtacgtaccgtccgtcccgtcccgtccg

SEQ ID NO: 176969 - DNA, 465 bp, Homo sapiens
  misc_feature: GYAE6OF01CPM73.37.78.H01.1.454.CMB.1.raw
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(465): a, c, t, g, unknown or other
  misc_feature (456)..(465): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaactcatcatttttgaggtcactaatcggcctcaggaatttcttctcgcttctctgcctccaagtctggcaacacggcctcttgaccatctctgggctccagactgaggacgaggctgattattactgcagttcatatagaggcacacacttatgtcttcggaagtgggaaccaaggtcgtcgtcctaagtcacgccaacggcccaaaccccatcgtcaacttctcgttccccgccctcctcactctactactacctgacgcgggctggcaaggccganangnnnnnnnnnn

SEQ ID NO: 176970 - DNA, 458 bp, Homo sapiens
  misc_feature: GYAE6OF01EVZU0.37.78.H01.1.454.CMB.1.raw
  modified_base (443)..(443): a, c, t, g, unknown or other
  misc_feature (443)..(443): n is a, c, g, or t
  modified_base (449)..(458): a, c, t, g, unknown or other
  misc_feature (449)..(458): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggcccaaaccccactgtcactctcgttccccaccctccatctacactactgacgcgggctggcaaggcncatagnnnnnnnnnn

SEQ ID NO: 176971 - DNA, 507 bp, Homo sapiens
  misc_feature: GYAE6OF01C17YH.37.78.H01.1.454.CMB.1.raw
  modified_base (301)..(301): a, c, t, g, unknown or other
  misc_feature (301)..(301): n is a, c, g, or t
  modified_base (487)..(507): a, c, t, g, unknown or other
  misc_feature (487)..(507): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatctatttttgaggtcactaatcgcctcaggtaatttctctcgcttctctgcctccaagtctggacaacacggcctccttgaccatctctggcctccagactgaggacgaggctgattattacngcagttcatataggagcaccactacttatgtcttacggaagtcgggaccaaggttcgtacgtacctaagtccgacgcccaaacggcccaaaccccgtactgtacctaaccttcgtcccgttccccaaccctcctactactcctaaccactactgacgccggtctacggacaaggcgacaagtacgnnnnnnnnnnnnnnnnnnnnn

SEQ ID NO: 176972 - DNA, 462 bp, Homo sapiens
  misc_feature: GYAE6OF01DL3HG.37.78.H01.1.454.CMB.1.raw
  modified_base (386)..(386): a, c, t, g, unknown or other
  misc_feature (386)..(386): n is a, c, g, or t
  modified_base (444)..(444): a, c, t, g, unknown or other
  misc_feature (444)..(444): n is a, c, g, or t
  modified_base (450)..(462): a, c, t, g, unknown or other
  misc_feature (450)..(462): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggcccaaccccntgtcactctcgttccccaccctcctcactctacactactgacgcgggctggcaaggcncatagnnnnnnnnnnnnn

SEQ ID NO: 176973 - DNA, 455 bp, Homo sapiens
  misc_feature: GYAE6OF01DYPX2.37.78.H01.1.454.CMB.1.raw
  modified_base (383)..(383): a, c, t, g, unknown or other
  misc_feature (383)..(383): n is a, c, g, or t
  modified_base (444)..(455): a, c, t, g, unknown or other
  misc_feature (444)..(455): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgctgctcatatgcaggtatcactcttatgtcttcggactgggaccaaggtcaccgtctaagtcagcccaaggcccaaccccnctgtcactctcgttccccacctcctcatctacactctgacgcggctggcaaggcgcatagnnnnnnnnnnnn

SEQ ID NO: 176974 - DNA, 457 bp, Homo sapiens
  misc_feature: GYAE6OF01CL0Y3.37.78.H01.1.454.CMB.1.raw
  modified_base (247)..(247): a, c, t, g, unknown or other
  misc_feature (247)..(247): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
  modified_base (446)..(457): a, c, t, g, unknown or other
  misc_feature (446)..(457): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacncggcctcctgaccatctctgggctccagactgaggacgaggctgattatactgcagttcatatagaggcgaccacacttatgtcttacggaagtggaccaaggtcgtcgtcctaagtcagcccaaggcccaaccccnctgtcactctcgttcccgccctcctcnctctacactactgagcggctcggcaggcgcatagnnnnnnnnnnnn

SEQ ID NO: 176975 - DNA, 494 bp, Homo sapiens
  misc_feature: GYAE6OF01EUKKA.37.78.H01.1.454.CMB.1.raw
  modified_base (396)..(396): a, c, t, g, unknown or other
  misc_feature (396)..(396): n is a, c, g, or t
  modified_base (470)..(472): a, c, t, g, unknown or other
  misc_feature (470)..(472): n is a, c, g, or t
  modified_base (476)..(494): a, c, t, g, unknown or other
  misc_feature (476)..(494): n is a, c, g, or t
tcagtagtgtagatcacgaccggtgctcgatttagtgtgagtagtttgggtttgggggctttgtctgggtctcctggacagtcgatcaccatccccctgcactggaaccagtagtgacgttgatgattatgactatgtctcctggtttcaacaacacccagacaaacgcccccaaactcatcatttttgaggtcactaatcggccctcaggaatttcttctcgcttctctgcctccaagtctggcaacacggcctccttgaccatctctgggcctccagactggaggacgaggctgtattattactgctagttcatagtaggaggccgaccacacttatgtcgtacggagtcggaccaaggtcgtcgtactaagtcacgcccaaggcccaaccctntcgtacaccttctcgttccccaccctctcactctaccactactcgacgcgggctacggcaacggcacgagtagnnngcannnnnnnnnnnnnnnnnnn

SEQ ID NO: 176976 - DNA, 492 bp, Homo sapiens
  misc_feature: GYAE6OF01AYDV7.37.78.H01.1.454.CMB.1.raw
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (464)..(465): a, c, t, g, unknown or other
  misc_feature (464)..(465): n is a, c, g, or t
  modified_base (467)..(474): a, c, t, g, unknown or other
  misc_feature (467)..(474): n is a, c, g, or t
  modified_base (477)..(492): a, c, t, g, unknown or other
  misc_feature (477)..(492): n is a, c, g, or t
tcagtagtgtagatcacgaccggtgctcgatttagtgtgagtagtttgggtttgggggctttgtctgggtctccctggacagtcgatcaccattcccctgcactggaaccagtagtgacgttgatgattatgactatgtcttcctggtttcaacacaccctagacaaagcccccaaactcatcatttttgaggtcactaatcggccctcaggaatttcttcgtcgcttctctgcctcgaagtctggcaacacggcctcttgatcatctctgggctccagactgagacgaggctgattattactgcagttcatataggaggcgaccacacttatgtcttcggaagtgggaccaagggtcgtacgtacctaagtcacgcccaaaggcccaaaccccgatcgtaccactctgttccccacctccctcattcctacactacngtacgcggctggcaaggcncanaggnngnnnnnnnntcnnnnnnnnnnnnnnnn

SEQ ID NO: 176977 - DNA, 608 bp, Homo sapiens
  misc_feature: GYAE6OF01ENJLL.37.78.H01.1.454.CMB.1.raw
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (606)..(607): a, c, t, g, unknown or other
  misc_feature (606)..(607): n is a, c, g, or t
tcagtagtgtagatcacgaccggtgctcgatttagtgtgagtagtttgggtttggggggctttgtctgggtctcctggacagtcgatcaccatcccctgcactggaaccagtagtgacgttgatgattatgactatgtctcctggtttcaaacaactacccagacaaagcccccaaactcatctatttttgaggtcactaatcggcctcaggaactttcttctcgcttctctgcctccaagtctggcaacacggcctccttgaccatctctgggctccagacctggacgacgaggctgattatactgcagttcatataggacgcgaccactacttatcgtcgttcggaaggtggggaacctaaggggttccgtcggtaccgtaaaggttccaacggtccccaagggccccaaaccccctgttacgtaccctaccttccttccggtttacccccaccccttcccgttacctaacgttacccttaacctaaccttaccgttacggtaacgggtccggggtcctacgggaccaaacggggtctaccgaactaacggnacgtcngtgctgccgagtcgagacntanacgtnncncncncncncananctnnc

SEQ ID NO: 176978 - DNA, 471 bp, Homo sapiens
  misc_feature: GYAE6OF01EK3XP.37.78.H01.1.454.CMB.1.raw
  modified_base (385)..(385): a, c, t, g, unknown or other
  misc_feature (385)..(385): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
  modified_base (458)..(471): a, c, t, g, unknown or other
  misc_feature (458)..(471): n is a, c, g, or t
tcagtagtgtagatcacgaccggtgctcgatttagtgtgagtagtttgggtttgggggctttgtctgggtctcctggacagtcgatcaccatccccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagagcgaccacacttatgtcttggaagtgggaccaaggtcgtcgtcctaagtcagcccaaggcccaaccccnctgtccacttcgtcgtccccaccctctcacttctaccnctacngacgcgggctcggcaacggcgacatagnannnnnnnnnnnnnn

SEQ ID NO: 176979 - DNA, 571 bp, Homo sapiens
  misc_feature: GYAE6OF01BO2R3.37.78.H01.1.454.CMB.1.raw
  modified_base (413)..(413): a, c, t, g, unknown or other
  misc_feature (413)..(413): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagtagtgtagatcacgaccggtgctcgattttagtgtgagtagtttgggtttgggggggctttggtctgggtctccctggacagtcgatcaccatcccctgcacgtcggaaccagtagtgatattggaaacttataaccttgtctcttggtaccaacagcacccaggcaaagcccccaaatcatgatttgtgaggacagtaagcggcctcaggggtttctaatcgcttctctggctccaagtctggcaacacggcctccctgaccgaatctcgtgggctccaggctgaggacgaggctgattattactgactagctacatactgcaggtagtcacttcttatcgtacttacggaacgttgggaaccaagggtccaaccggttcctaagtccaacgccgaaggcccaacccnctcggtcacgttcttcgttccccgcccttctcacttcccgtaactacctacgtacggacgtcggggtactgggacgaacggtccgacaagttacgatcgtatacagtntgtgcnctctctcgtcgtcgtcgagacgcgagagacgtananancngngc

SEQ ID NO: 176980 - DNA, 517 bp, Homo sapiens
  misc_feature: GYAE6OF01EQNJD.37.78.H01.1.454.CMB.1.raw
  modified_base (332)..(332): a, c, t, g, unknown or other
  misc_feature (332)..(332): n is a, c, g, or t
  modified_base (495)..(495): a, c, t, g, unknown or other
  misc_feature (495)..(495): n is a, c, g, or t
  modified_base (499)..(517): a, c, t, g, unknown or other
  misc_feature (499)..(517): n is a, c, g, or t
tcagtagtgtagatcacgaccggtgctcgatttagtgtgagtagtttgggtttgggggctttgtctgggtctcctggacagtcgatcaccatccccctgcactggaaccagcagtgatattgaaacttataaccttgtctcttggtaccaacagcacccaggcaaagccccccaaactcatgattttgtgaggacagtaagcggccctcaggggtttctaatcgcttctctggctccaagtctggcaacaccggccctccctgacaatctcgtgggctccaggctgaggacgaggctgattattactgctgctcatatgcaggtatcacttnttatgtcttcggactggaccaggtccaccgtctaagtccagacccaacgggccccaacccccgactcgtccaccttcgttccgtttcccccgccccttccctctacttacctacctaaccttactcggacggccgggtctcggaccaacgggccgcaagtagntcgnnnnnnnnnnnnnnnnnnn

SEQ ID NO: 176981 - DNA, 511 bp, Homo sapiens
  misc_feature: GYAE6OF01D44IX.37.78.H01.1.454.CMB.1.raw
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (485)..(511): a, c, t, g, unknown or other
  misc_feature (485)..(511): n is a, c, g, or t
tcagtagtgtagatcacgaccggtgctcgattttagtgtgagtagtttgggtttgggggcctttgtctgggtctccctggacagtcgactcaccatccccctgccactggaaccagtagtgacgttgatgatttatgactatgtctcctggtttcaacaacacccagacaaagcccccaaactcatcattttttgaggtcactaatcggccctcaggaatttcttctcgcttctctgcctccaagtctggcaacacggcctccttgaccatctctgggctccagactgaggaccgaggctgtattattacgtgcgagttcaattataggaggccgaccacacttatgtacttcggaagtgggaccaaggtcgtcgtcctaagtcaacgtcccaaggccccaaacccccatcgtaccacttcttcgttccccgcccttcctcattcctacactactgagccgggctcggacgaaggcncatagntnnnnnnnnnnnnnnnnnnnnnnnnnnn

SEQ ID NO: 176982 - DNA, 454 bp, Homo sapiens
  misc_feature: GYAE6OF01EG3NY.37.78.H01.1.454.CMB.1.raw
  modified_base (249)..(249): a, c, t, g, unknown or other
  misc_feature (249)..(249): n is a, c, g, or t
  modified_base (381)..(381): a, c, t, g, unknown or other
  misc_feature (381)..(381): n is a, c, g, or t
  modified_base (445)..(454): a, c, t, g, unknown or other
  misc_feature (445)..(454): n is a, c, g, or t
tcagtagtgtagatcacgaccggtgctcgatttagtgtgagtagtttgggtttgggggctttgtctgggtctcctggacagtcgatcaccatccccctgcactggaaccagtagtgacgttgatgattatgactatgtctcctggtttcaacaacacccagacaaacgcccccaaactcatcatttttgaggtcactaatcggccctcaggaatttcttctcgcttctctgcctccaagtctggcaacncggcctcttgaccatctctgggctccagactgaggacgaggctgatttattactgcagttcatatagagcacacacttatgtcttcggaagtggaccaaggtctcgtctaagtcacgcccaagcccaacccntgtcactctcgttccccaccctcctcattctacactctgagcgggctggacaagggcacatagnnnnnnnnnn

SEQ ID NO: 176983 - DNA, 602 bp, Homo sapiens
  misc_feature: GYAE6OF01DLM7B.37.78.H01.1.454.CMB.1.raw
  modified_base (274)..(274): a, c, t, g, unknown or other
  misc_feature (274)..(274): n is a, c, g, or t
  modified_base (501)..(501): a, c, t, g, unknown or other
  misc_feature (501)..(501): n is a, c, g, or t
tcagtagtgtagatcacgaccggtgctcgatttagtgtgagtagtttgggtttgggggctttgtctgggctctgctgctcctcaccctcctcactcagggcatagggtcctgggcccagtctgccctgactcagcctgccctccgtgtctgggtctcctggacagtcgatcaccatcctcctgcactcggaacccgcagtgacgttggtgttataactatgtctcttggtaccaacatccacccaggacaaacgtccccaaactcatgatttangaggtcactaaacggccctcgagggtctctaatcgtcttctctggcctacaagtctggcaacgacggccctccctgaccatctcgtcgggctccgagctggaccgacgacggctctactatttattgcagctctatactacaagcagcatctacgttgggtcgttcgggagggacgggacccgtacgtacggaccgttacgttacgggtcacggacccgaaggtccnccgtacccccgtggtccctaccgtccgttccgttacccccacccgttccctaccgtacttacccttaacctaccttaccgtcggcgggtccgggtaccggg

SEQ ID NO: 176984 - DNA, 599 bp, Homo sapiens
  misc_feature: GYAE6OF01D9SRJ.37.78.H01.1.454.CMB.1.raw
  modified_base (209)..(209): a, c, t, g, unknown or other
  misc_feature (209)..(209): n is a, c, g, or t
  modified_base (501)..(501): a, c, t, g, unknown or other
  misc_feature (501)..(501): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
  modified_base (548)..(548): a, c, t, g, unknown or other
  misc_feature (548)..(548): n is a, c, g, or t
  modified_base (558)..(558): a, c, t, g, unknown or other
  misc_feature (558)..(558): n is a, c, g, or t
  modified_base (577)..(579): a, c, t, g, unknown or other
  misc_feature (577)..(579): n is a, c, g, or t
  modified_base (581)..(582): a, c, t, g, unknown or other
  misc_feature (581)..(582): n is a, c, g, or t
  modified_base (585)..(585): a, c, t, g, unknown or other
  misc_feature (585)..(585): n is a, c, g, or t
  modified_base (587)..(594): a, c, t, g, unknown or other
  misc_feature (587)..(594): n is a, c, g, or t
  modified_base (596)..(599): a, c, t, g, unknown or other
  misc_feature (596)..(599): n is a, c, g, or t
tcagtagtgtagatcacgaccggtgctcgatttagtgtgagtagtttgggtttgggggctttgtctgggtctcctggacagtcgatcaccatcccctgcacctggaaccagtagtgacgttgatgattatgactatgtctcctggtttcaacaacaccagacaaagcccccaaatcaatccatttttcgaggtcactaagtcggccctnaggaatttctctcgcttctctgcctccaagtctggacaaccacggcctcttgacctattctacggctcctacgactacgaggacgaacggcgtacgtagtacttacttcgacgtacgttacgtacgtatagtacgggacgaccgtaacctacgttaactagttacgttaaccggtaacggacgggtaccgaacggtacggttaccgtactacggtactacggacccgaacggaacccgaccccgtaaactcggtaccactaaccttcgggtaccccctccctaccctctaanaccttaacgactcgtaccgnggaccgggnttacggagaacgtccggnaatagggtcntacgatccagctagatggnnngnnagnannnnnnnnannnn

SEQ ID NO: 176985 - DNA, 539 bp, Homo sapiens
  misc_feature: GYAE6OF01E3RZD.37.78.H01.1.454.CMB.1.raw
  modified_base (306)..(306): a, c, t, g, unknown or other
  misc_feature (306)..(306): n is a, c, g, or t
  modified_base (514)..(514): a, c, t, g, unknown or other
  misc_feature (514)..(514): n is a, c, g, or t
  modified_base (517)..(539): a, c, t, g, unknown or other
  misc_feature (517)..(539): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaactcatctatttttgaggtcactaatcggccctcaggtatttcttctcgcttctctgcctccaagtctggacaacacgtcctccttgaccatctctgggcctccagactgacggacgaggctgattattacngctagttcatagtaggacggccgaaccactacttatcgttcttacgggaagtgggaaccgtaggtccgtcgttactaacgcaccgacccgaacggcccccaaacccctctcgtacctaccttccgttaccgttccccccacccttcctactacttaccctaaccactacgtcggaccgcggggtcctggaccgaacggcaccagtagnacnnnnnnnnnnnnnnnnnnnnnnn

SEQ ID NO: 176986 - DNA, 564 bp, Homo sapiens
  misc_feature: GYAE6OF01C5MWH.37.78.H01.1.454.CMB.1.raw
  modified_base (311)..(311): a, c, t, g, unknown or other
  misc_feature (311)..(311): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (546)..(564): a, c, t, g, unknown or other
  misc_feature (546)..(564): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaactcatctatttttgagtacactaatccggccctcagtaatttctctcgcttctctcgcctccaagtctggacaacaccggccttccttgaccatctcgtcggctccagactggaggacgaggctagattattacgngactagttcaatagtagacggaccaccatacttatcgtacgtttacgaaggtcggaaccctaaggtccgtacgtaccgtaagtccaacggtcccccgaagggtacccccaaaccccgtattacgtacccaacctttcccgtacccgtttcccccgaccctttccctacaactttcctaaccctactaaccgtcggacgtccgggctcgggacccaaggtcccgataanacggncnnnnnnnnnnnnnnnnnnn

SEQ ID NO: 176987 - DNA, 719 bp, Homo sapiens
  misc_feature: GYAE6OF01AYZ50.37.78.H01.1.454.CMB.1.raw
  modified_base (644)..(644): a, c, t, g, unknown or other
  misc_feature (644)..(644): n is a, c, g, or t
  modified_base (671)..(671): a, c, t, g, unknown or other
  misc_feature (671)..(671): n is a, c, g, or t
  modified_base (710)..(710): a, c, t, g, unknown or other
  misc_feature (710)..(710): n is a, c, g, or t
tcagtagtgtagatcacgaccggtgctcgatttagtgtgagtagtttgggtttgggggctttggtctgggtctcctggacagtcgatcaccatcccctgcactggaaccgacgtagtgatattgaaacgttataaccttgtctcttggtaccaacagcacccaggacaagcccccaaactcatgatttgcgaggacagtaagccgccctcgaggggttttcaatcgtcttctacgtggacctaccgaaagttcctaggacctaaaccgaccgggtccccttccccgtagaacctaatcctaccgtaggggtacctacctaagggtacttggaacggaccgaaggcctagaaactttagttaaccgtcgtactcgcctacgattagtcgacgtaggtactacctacctttacgtttatcggttaccgtttaccgggaacccttacgggaacccgtaagggttccccgaacccggttaccgtaacggtaccgacggtaccccgaacggaccccaaaccccctagtccgttaccacttcccttaccgtacccctacccgtccttacgacttacccgtaacctacccttacgtcggaacggtccggttacgtaccggtaccgtaacgggccgtaccaagtcgtatacncgtagtcctacgctacgacgagaccgngtacacgtacgacgtacacgtcgacgtcacgtacacacnctcgtcgtc

SEQ ID NO: 176988 - DNA, 592 bp, Homo sapiens
  misc_feature: GYAE6OF01C61PO.37.78.H01.1.454.CMB.1.raw
  modified_base (116)..(116): a, c, t, g, unknown or other
  misc_feature (116)..(116): n is a, c, g, or t
  modified_base (188)..(188): a, c, t, g, unknown or other
  misc_feature (188)..(188): n is a, c, g, or t
  modified_base (550)..(550): a, c, t, g, unknown or other
  misc_feature (550)..(550): n is a, c, g, or t
  modified_base (564)..(566): a, c, t, g, unknown or other
  misc_feature (564)..(566): n is a, c, g, or t
  modified_base (569)..(592): a, c, t, g, unknown or other
  misc_feature (569)..(592): n is a, c, g, or t
tcagtagtgtagatcacgaccggtgctcgatttagtgtgagtagtttggggtttgggggctttgtctgggtctcctggacagtcgatcaccatcccctgcactggaaccagcagtnatattgaaacttataccttgtctcttggtaccaacagcaccaggcaaacgcccccaaactcatgtatttggngaggacagtaacgcggcctcgagggtttcaagtcgtcttcgtctggctccgaagtctcggacaacgaccgcctcccagactaatcctcgttacgggccttacgaggcaggtaacggacgaggtacctagtaatttatacgtcgtactgacctctaataggtcggactaagggtactacgtacctattacgtacgttcgtacggtaaacgtacggaaccgtaaacgtaccctaacccgtctaaaacggtccacggaccccaaacggtcccccaaaccgttgtctactaccgttcgttaccccgtcccgacccctttagacgactttccgaaactaccgtaagtccggaagggtcccgggtaancgacgaggctagannnctnnnnnnnnnnnnnnnnnnnnnnnn

SEQ ID NO: 176989 - DNA, 586 bp, Homo sapiens
  misc_feature: GYAE6OF01D9EXO.37.78.H01.1.454.CMB.1.raw
  modified_base (557)..(557): a, c, t, g, unknown or other
  misc_feature (557)..(557): n is a, c, g, or t
  modified_base (561)..(562): a, c, t, g, unknown or other
  misc_feature (561)..(562): n is a, c, g, or t
  modified_base (564)..(586): a, c, t, g, unknown or other
  misc_feature (564)..(586): n is a, c, g, or t
tcagtagtgtagatcacgaccggtgctcgatttagtgtgagtagtttgggtttgggggctttgtctgggtctcctggacagtcgaatcaccatcccctgcactggaaccagtagtgacgttgatgattatgactatgtctctggtttcaacaacaccagaacaaacgcccccaaactcatctatttttgaggtcactaagtcggcctcagtatttcttctcgcttctctcgcctaccaagtctggaccaaccgccggtccttccttacgaccacttcctcgtcgggcctaccagacgtggacggacgagcctacacttatttatgcgagtctacataactaacaacgcacgactacgttacgttacggtttggggttcggttcggggaccgggtacggggaccgtaccgttcggtacccggttcgttacggtccaacggacccgaacgtccgtcccgtccccgtcggtccacgttccgtcccgttccccgccccttcccttaccactacctactacctacgtacggacggtcgggtcgtcggacgacggacacgtanaggnntnnnnnnnnnnnnnnnnnnnnnnn

SEQ ID NO: 176990 - DNA, 467 bp, Homo sapiens
  misc_feature: GYAE6OF01CJAA7.37.78.H01.1.454.CMB.1.raw
  modified_base (443)..(443): a, c, t, g, unknown or other
  misc_feature (443)..(443): n is a, c, g, or t
  modified_base (449)..(467): a, c, t, g, unknown or other
  misc_feature (449)..(467): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctcaagtctggcaacacggcctcctgaccatctcgtggctccagactgaggacgaggctgattatactgcagttcatatagaggcgaccactacttatgtcttcggaagtcggaccaaggtcgtcgtacctagtcacgcccaaggccccaacccatcgtcacttctcgttcccacctccatcctacactactgacgcgggctggcaaggcganactagnnnnnnnnnnnnnnnnnnn

SEQ ID NO: 176991 - DNA, 513 bp, Homo sapiens
  misc_feature: GYAE6OF01A88G2.37.78.H01.1.454.CMB.1.raw
  modified_base (487)..(489): a, c, t, g, unknown or other
  misc_feature (487)..(489): n is a, c, g, or t
  modified_base (491)..(513): a, c, t, g, unknown or other
  misc_feature (491)..(513): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttctctcgcttctctggctccaagtctggcaacacggcctccctgacaatctctgggctccaggctgaggacgaggctgattatactgctgctcatatgcaggtactcacttcttaagtgttacttcggaaacttgggaacctaaggtccaccgtctaagtcacgacccaaggccccaaaccccatcgtaccacgttctccgttccccgaccccttccgtccagttcctaactactactcggacgccgggctcggacgaaggtccactaatacgnnncnnnnnnnnnnnnnnnnnnnnnnn

SEQ ID NO: 176992 - DNA, 558 bp, Homo sapiens
  misc_feature: GYAE6OF01AUF2N.37.78.H01.1.454.CMB.1.raw
  modified_base (291)..(291): a, c, t, g, unknown or other
  misc_feature (291)..(291): n is a, c, g, or t
  modified_base (530)..(558): a, c, t, g, unknown or other
  misc_feature (530)..(558): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggtaatttcttctcgcttctctcgcctccaagtctggcaacacggcctccttgaccatctctcgggcctccagactgaggacgnggctgtattattctgcagttcaatataggacggcgacccactactttatgttccgttacgggaaggttcgggaacctaagggtcgtcgtacctaagtcacgacccaacggaccccaaaccccgtctcgtaccacttccgttaccgttcccccgcccttccctctacttaccctacctaccttacttcggaacggtccgggtaccgtcgggtaccgaacgggcccgtacgaacgttacgnnnnnnnnnnnnnnnnnnnnnnnnnnnnn

SEQ ID NO: 176993 - DNA, 526 bp, Homo sapiens
  misc_feature: GYAE6OF01BS0RT.37.78.H01.1.454.CMB.1.raw
  modified_base (409)..(409): a, c, t, g, unknown or other
  misc_feature (409)..(409): n is a, c, g, or t
  modified_base (501)..(502): a, c, t, g, unknown or other
  misc_feature (501)..(502): n is a, c, g, or t
  modified_base (505)..(526): a, c, t, g, unknown or other
  misc_feature (505)..(526): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggcctccagactgaggacgaggctgattattactgcagttcatataggaggcgaccacacttatcgtcttacgggaagtcggggaacctaagggtccgttcgtaccttaaagtcacgaccccgaagggccccaaaccccgntcgtccacttcctcgttaccccacccctcctctactccctaacaccttactcgacgggtcccgggactcgggcgaacgggccgaccagtagnngcnnnnnnnnnnnnnnnnnnnnnn

SEQ ID NO: 176994 - DNA, 524 bp, Homo sapiens
  misc_feature: GYAE6OF01CHZA5.37.78.H01.1.454.CMB.1.raw
  modified_base (247)..(247): a, c, t, g, unknown or other
  misc_feature (247)..(247): n is a, c, g, or t
  modified_base (465)..(465): a, c, t, g, unknown or other
  misc_feature (465)..(465): n is a, c, g, or t
  modified_base (500)..(524): a, c, t, g, unknown or other
  misc_feature (500)..(524): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaactcatctatttttgagtcactaatcggccctcagtaatttcttctcgcttctctgcctcaagtctggcaacncgcctcctgaccatctctcgggctccagactgacggacgaggctgtattattactgctagttcatatagacggcaccactacttatcgtcgttacggaagtcggggaacctaagggttcgtacgtaccgtaagtcgaacgcccaaaggccccaaacccccgatcgtcctaccttccgttcgttccccccacccttcctctacttacctacaccttacnggacggcgggtcgaggtaccaggtccgctaatagnnnnnnnnnnnnnnnnnnnnnnnnn

SEQ ID NO: 176995 - DNA, 620 bp, Homo sapiens
  misc_feature: GYAE6OF01CYR8J.37.78.H01.1.454.CMB.1.raw
  modified_base (294)..(294): a, c, t, g, unknown or other
  misc_feature (294)..(294): n is a, c, g, or t
  modified_base (593)..(593): a, c, t, g, unknown or other
  misc_feature (593)..(593): n is a, c, g, or t
  modified_base (595)..(620): a, c, t, g, unknown or other
  misc_feature (595)..(620): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaactcatcatttttgaggtcactaatcggcctcaggtaatttctctcgcttctctgcctccaagtctggccaacacggccctccctgaccatctctgggctccaacctgaggacgaggctnactatatgcagctacatactacaagcagtctacgtacgtttggggtacgttccgggacgggaacggggacccgtaccgttacgtacccggttcgtttacgggaccaaccggaccccgtaaacgggtcccgtacccggtcccccccgttacgggttccctaacccgttcccggttcccggtttcccccggtcccccttaccccgttacctaacctttaccccttaacccgtaacccttaaccggttcggaccgggtcccggggtcgttaccggggacgaacgggtccgactagtaccggncnnnnnnnnnnnnnnnnnnnnnnnnnn

SEQ ID NO: 176996 - DNA, 495 bp, Homo sapiens
  misc_feature: GYAE6OF01D1P1M.37.78.H01.1.454.CMB.1.raw
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (464)..(464): a, c, t, g, unknown or other
  misc_feature (464)..(464): n is a, c, g, or t
  modified_base (472)..(473): a, c, t, g, unknown or other
  misc_feature (472)..(473): n is a, c, g, or t
  modified_base (475)..(495): a, c, t, g, unknown or other
  misc_feature (475)..(495): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgccccccaaaactcatctatttttgaggtcactaatcggccctcaggaatttcttctcgcttctctgcctccaagtctggcaacncggcctccttgaccatctcgtgggcctccagctgaggacgagctgattnttacngcagttcatagagaggcaccatacttntgttcgtaggaagtcgggacgtaagggtcctcgtacctaagtcacgcccaacggcccaaccccnttcgtccacttccgtcttccccacccttctcacttctactacctatcggacgcgggctggacacggcnctaatgcnncnnnnnnnnnnnnnnnnnnnnn

SEQ ID NO: 176997 - DNA, 689 bp, Homo sapiens
  misc_feature: GYAE6OF01AFLA9.37.78.H01.1.454.CMB.1.raw
  modified_base (226)..(226): a, c, t, g, unknown or other
  misc_feature (226)..(226): n is a, c, g, or t
  modified_base (642)..(642): a, c, t, g, unknown or other
  misc_feature (642)..(642): n is a, c, g, or t
  modified_base (649)..(650): a, c, t, g, unknown or other
  misc_feature (649)..(650): n is a, c, g, or t
  modified_base (658)..(658): a, c, t, g, unknown or other
  misc_feature (658)..(658): n is a, c, g, or t
  modified_base (662)..(662): a, c, t, g, unknown or other
  misc_feature (662)..(662): n is a, c, g, or t
  modified_base (666)..(666): a, c, t, g, unknown or other
  misc_feature (666)..(666): n is a, c, g, or t
  modified_base (669)..(670): a, c, t, g, unknown or other
  misc_feature (669)..(670): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggttcaacaacaccagacaacaccccaactcatctatttttgagtcactatccgcctctaggtactttctctcgtcttctctcncctacagtctaggacaacgacggtcctcttcgacctacttctcgtcgggaacctcgacgacgtaggaacgggacgaggtacgtagtatttaacttacgtcgtactacgttacaagtaagtacggacggaccgtaacctaacgttactttagtacggttaccgtttaacggggaacggttaccgggaaccgtaacggggttccgttaccggtaaccttaaggtacccgaaccggtacccgaaacccggtacccctaaaccccgtacgttacgtaccctaccgtttcccgttacccgttaccccctacccttacccttaacttacccgttaacccttaacgtaaccgttaaccgtcgggtaccgggaccgggttacgtacgggtaccgaaccgggtacgaccgtaagtaacgctggcncgtacannacgcgacncacncacngcnncgtncnactcacanctngc

SEQ ID NO: 176998 - DNA, 462 bp, Homo sapiens
  misc_feature: GYAE6OF01CEW2Z.37.78.H01.1.454.CMB.1.raw
  modified_base (360)..(360): a, c, t, g, unknown or other
  misc_feature (360)..(360): n is a, c, g, or t
  modified_base (450)..(462): a, c, t, g, unknown or other
  misc_feature (450)..(462): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggtaatttcttctcgcttctctgcctccaagtctggcaacacgcctcctgaccatctctgggctccagactgaggacgaggctcactattattgcagctcatatacaagcagcatcacttgggtgttcggcggagggaccgacctggaccgtnttaggtcagcccaaggctcgccccctcggtcactctcgttccccacctccctcactctacactactgagccggctggcgaggcgcatagnnnnnnnnnnnnn

SEQ ID NO: 176999 - DNA, 568 bp, Homo sapiens
  misc_feature: GYAE6OF01BXSJG.37.78.H01.1.454.CMB.1.raw
  modified_base (210)..(210): a, c, t, g, unknown or other
  misc_feature (210)..(210): n is a, c, g, or t
  modified_base (302)..(302): a, c, t, g, unknown or other
  misc_feature (302)..(302): n is a, c, g, or t
  modified_base (537)..(538): a, c, t, g, unknown or other
  misc_feature (537)..(538): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (548)..(568): a, c, t, g, unknown or other
  misc_feature (548)..(568): n is a, c, g, or t
tcagtagtgtagatcacgaccggtgctcgatttagtgtgagtagtttgggtttgggggctttgtctgggtctcctggacagtcgatcaccatccccctgcactggaaccagtagtgacgttgatgattatgactatgtctcctggtttcaacaacacccagacaaacgcccccaaaactcatctatttttgaggtcactaatcggccctnaggtaatttcttctcgcttctctgcctccaagtctcggcaacgaccggcctccttgacctatcctcgtgggcctccgagactggaggacggnggctgtatttattactgctagttacattagtaggaggaccaccactacttatgttcgttagggaaggtggaacctaggtcgtcgtactaagtccgacgacccgaacggaccccaacccctagtccgtaccacttcccgttccgttaccccccaccccttcctactaacttcccttaaacacctttacgcggacgggtccgggtcgtagggacccgtaaggcgaaccgtacaaggnngtacntnncnnnnnnnnnnnnnnnnnnnnn

SEQ ID NO: 177000 - DNA, 704 bp, Homo sapiens
  misc_feature: GYAE6OF01CZ2EF.37.78.H01.1.454.CMB.1.raw
  modified_base (666)..(666): a, c, t, g, unknown or other
  misc_feature (666)..(666): n is a, c, g, or t
  modified_base (676)..(676): a, c, t, g, unknown or other
  misc_feature (676)..(676): n is a, c, g, or t
  modified_base (678)..(704): a, c, t, g, unknown or other
  misc_feature (678)..(704): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctctgttacaacacaccagacaacgacccccaaactcatctatttttgacgtcactaagtccggtccctagaggttatttcttcctcgtcctttcctcgtcgtccctccgtaacgttcgtacggaccaaccgtaccggtcccttaccgttacgacctacttccttcggtcgggtacctaccgtaacggtaccggttagggaaccgggtacgggacggtaccgtttaagttaattttaaccttacgtcggtaaccttacgtttaccaaagtttaggaacgggaccgggtaaccccaacctaccgtttaaacctttagttacggtttaccggttaacgggtaaaggtaccgggtacgttaaacggttccgttacgtaccgtaagtccgaacctaacccgaaccgacccctaaccctacgtcgttccctaaccttcgttacccggttacccccctccccgttactaccgtaaccttaccctaaccgtaacgtaacggtcgacgggtccgggttacaccggtacgacggtacncgttagactnannnnnnnnnnnnnnnnnnnnnnnnnnn

SEQ ID NO: 177001 - DNA, 645 bp, Homo sapiens
  misc_feature: GYAE6OF01DAXJ7.37.78.H01.1.454.CMB.1.raw
  modified_base (133)..(133): a, c, t, g, unknown or other
  misc_feature (133)..(133): n is a, c, g, or t
  modified_base (177)..(177): a, c, t, g, unknown or other
  misc_feature (177)..(177): n is a, c, g, or t
  modified_base (222)..(222): a, c, t, g, unknown or other
  misc_feature (222)..(222): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (618)..(621): a, c, t, g, unknown or other
  misc_feature (618)..(621): n is a, c, g, or t
  modified_base (623)..(625): a, c, t, g, unknown or other
  misc_feature (623)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(636): a, c, t, g, unknown or other
  misc_feature (631)..(636): n is a, c, g, or t
  modified_base (639)..(644): a, c, t, g, unknown or other
  misc_feature (639)..(644): n is a, c, g, or t
tcagtagtgtagatcacgaccggtgctcgatttagtgtgagtagtttgggtttgggggctttgtctgggtctcctggacagtcgatcaccatccctgcactggaaccagtagtgacgttgatgattatgactntgtctcgtgttacaacaacaccagacaacgccccaaatcatctnttttgagtcactactcggcctacagtaactttctctcgcttctcncgtcctcgtaatctggaccaacctcggtcccgtttactcgacctacttcgtcgttcggccttacgaagtaccgttggacggtaccggtaaggtcttaggtattttacgttaccgttcggtaccttaggttactaagtaacggttaaacggcggtaccaacctaacttacgtttaaatcggttacgtttacgggaaacggttacgggaaccgttaacgggtccgtaacgttaccgttaagtccgaacgtacccggaaaccgcccgtaaaacccctgtcgttaacctacgttccctttccggttccccacccttacctaccgtacttaccgttaactacgttaacggtcgacgggtacggtcgtacggacgaacggtctacgatgacgtnactgntcnnnncnnntncncnnnnnntcnnnnnnc

SEQ ID NO: 177002 - DNA, 650 bp, Homo sapiens
  misc_feature: GYAE6OF01BKNJR.37.78.H01.1.454.CMB.1.raw
  modified_base (343)..(343): a, c, t, g, unknown or other
  misc_feature (343)..(343): n is a, c, g, or t
  modified_base (570)..(570): a, c, t, g, unknown or other
  misc_feature (570)..(570): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (631)..(636): a, c, t, g, unknown or other
  misc_feature (631)..(636): n is a, c, g, or t
  modified_base (638)..(642): a, c, t, g, unknown or other
  misc_feature (638)..(642): n is a, c, g, or t
  modified_base (644)..(650): a, c, t, g, unknown or other
  misc_feature (644)..(650): n is a, c, g, or t
tcagtagtgtagatcacgaccggtgctcgatttagtgtgagtagtttttgggtttgggggctttgtctgggtctcctggacagtcgatcaccatcccctgcactggaaccagtagtgacgttgatgattatgactatgtctccttggtttacaacaacacccaagaacaaacgaccccaaatcatctattttgagtacaactaagccggcctagaggttaactttctctcgtcttctactcgtcctacctaagtcgtacgaacgaaaccgaccggtcccttaccttacgacctatcgtcgtcggctacgagactaggaagacgagtctagtaattactagtantacgtacaagtagtaaggacggaccgtaacctaacttactttacggtcggtttaaccggttaacgggtaaggggtaaccggaaacgtaacggggtttacccgtacgtaaaccgttaagtccgaaacggaaccccgtaaccgggaaccccaaaccctagttccgaactaccgttcttacccgtacccctaaccctcctaacgtaacgttactaacctaacgttacggnggtaaccgggtcgcgtaacggacgaaggccaataagtcnggtanacagtcatanantanannnnnnannnnnannnnnnn

SEQ ID NO: 177003 - DNA, 733 bp, Homo sapiens
  misc_feature: GYAE6OF01BHD6V.37.78.H01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgtgagtagtttgggtttggggctttgtctgggtctcctggacagtcgatcaccatcccctgcactcggaaccagtagtgacgttgatgattatgactatgtctcctgttacaacacaccagacaacgaccccaatcatctattttgagtcactatccggcctanaggtatttcgtctcgcttctctcgacctccaagttcctggaccaacgtcggtcccttacgttagaaccctgtcctcgtacgggcctacgagctaggaggacgaggtctagtaattacttacgtcggactacgtttacaattagtacggacgaccctactaaccgttacttagtacggtttaccgttacggggaacggttacggaaccgtaagggttcccgttacgtaaccgttaaacgccgaaccgtaacccgtaaacgggtaccccaaaccccttaggtaccttaccgtaccctttccggttaccccgttacccctaaacccccttcctaaccgttaccttaccctaaccggttaaccctacgggttacggaccggggtaccggttcgtaacgggaaccgttaacgggtccgaacgtaacgggttaacgcgtacgtcgtactacgtacgacgtacgtacgtacgtacgacgtacgtacgtacgtacgtacgacgcgtacgtacgtacgtacgtactacgtactgtacgtacg

SEQ ID NO: 177004 - DNA, 748 bp, Homo sapiens
  misc_feature: GYAE6OF01C68VV.37.78.H01.1.454.CMB.1.raw
  modified_base (269)..(269): a, c, t, g, unknown or other
  misc_feature (269)..(269): n is a, c, g, or t
  modified_base (716)..(716): a, c, t, g, unknown or other
  misc_feature (716)..(716): n is a, c, g, or t
  modified_base (722)..(722): a, c, t, g, unknown or other
  misc_feature (722)..(722): n is a, c, g, or t
  modified_base (728)..(731): a, c, t, g, unknown or other
  misc_feature (728)..(731): n is a, c, g, or t
  modified_base (733)..(734): a, c, t, g, unknown or other
  misc_feature (733)..(734): n is a, c, g, or t
  modified_base (736)..(748): a, c, t, g, unknown or other
  misc_feature (736)..(748): n is a, c, g, or t
tcagtagtgtagatcacgaccggtgctcgatttagtgtgagtagtttgggtttgggggctttgtctgggtctcctggacagtcgatcaccatcccctgcactggaaccagcagtgatattgaaacttataaccttgtctcttggtaccaacagcacccaggcaaacgcccccaaactcatgatttgtgaggacagtaagcggccctcgaggggtttctaatcgcttctctggctccaagtctggacaacgacggcctcctgacatcctntcgggctccaggctggacggacgaggtcctagtatttacttacgtgtctacgctactattacgtcgaccgtagggttactaccgttaccgttacgtttaagtcggtttacccgtttaacggggtaaaccgttacggggaaaccccgttaacgggttaaccccgtaacccgtttaacccgtttaaaacgggttcccaacccgggtaaccccccgaaacggggttaaaccccccctaaccccccgtaaccggttttaacggtacccccctttacgttaacccccggttttcccccggttacccccccttaacccccctttaccccggtaaaccttaacccttttacccgtaaaacccttaaccggttaccggtacgggtaacccggggtaccggggtccgttaccggggaaacccgaacgggttccggaacctaacgttcggacctagngtcacncgcgcnnnngnncnnnnnnnnnnnnn

SEQ ID NO: 177005 - DNA, 623 bp, Homo sapiens
  misc_feature: GYAE6OF01EXA2I.37.78.H01.1.454.CMB.1.raw
  modified_base (310)..(310): a, c, t, g, unknown or other
  misc_feature (310)..(310): n is a, c, g, or t
  modified_base (597)..(619): a, c, t, g, unknown or other
  misc_feature (597)..(619): n is a, c, g, or t
  modified_base (621)..(623): a, c, t, g, unknown or other
  misc_feature (621)..(623): n is a, c, g, or t
tcagtagtgtagatcacgaccggtgctcgatttagtgtgagtagtttgggtttgggggctttgtctgggtctcctggacagtcgatcaccatccccctgcactggaaccagtagtgatattgaaacttataaccttgtctcttggtaccaacagcacccaggcaaacgaccccccaaactcatgtatttgtggaggacagtaacgccggccctcgtaggggtttctaatcgtcttctctggctaccaagtctggacaaccgaccggccctccctgacatcctcgtggcctccgaggctaggagggaccgnggctgtatttacttactgtcgtcgctcaattacgcgtacgaacgggttacgtcttaccgtttcgtttattacggtttcgtaccgggtaacgtacgggggaaacctaacggtaccctaaccccgttacgtaacgtcaacccgacccgaaaccggaccccctaaacccctcttcgtacccacgttccgttcccggtaccccccgtccccttactcctacttacccgtaacctacgtaacgcgggtaacggcccggggtacgtcggacccgaacggtccacgtaatggcnnnnnnnnnnnnnnnnnnnnnnnannn

SEQ ID NO: 177006 - DNA, 631 bp, Homo sapiens
  misc_feature: GYAE6OF01CMO5R.37.78.H01.1.454.CMB.1.raw
  modified_base (221)..(221): a, c, t, g, unknown or other
  misc_feature (221)..(221): n is a, c, g, or t
  modified_base (560)..(560): a, c, t, g, unknown or other
  misc_feature (560)..(560): n is a, c, g, or t
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
  modified_base (593)..(593): a, c, t, g, unknown or other
  misc_feature (593)..(593): n is a, c, g, or t
  modified_base (602)..(602): a, c, t, g, unknown or other
  misc_feature (602)..(602): n is a, c, g, or t
  modified_base (626)..(626): a, c, t, g, unknown or other
  misc_feature (626)..(626): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgtttgatgattatgactatgtctcctgtttacaacaacaccagaacaacgaccccaaatcatctattttgagtcactatcgcctgagtattctctctcttctcncgcctcgagtctgacaacgcgccttctcgaccatctcgtcgctaccgagtacgtggacggacgtaggtacgtacgtattactacgtcgtacttagttactaataggacggacgacctaacctactacgttacgtcgttacggtacgggtaacggtaccggaacgttacggttccgttacgtacgtacgtacgaaccgacccgaaccgaccctaaccgtactccgtacctaccgttaccgttaccccgttacccctaccctacccttactacctaccgtaaccgtacgttacgacgggaccggtccggtacgaccggacgaccgtacgtaacgtaacgcncacgtcgactacncgcacgtcncgcgcacgtanacgtcgtangtgcacgtacgtacgtacacgtcngcgcg

SEQ ID NO: 177007 - DNA, 481 bp, Homo sapiens
  misc_feature: GYAE6OF02GYGYZ.37.78.H01.1.454.CMB.1.raw
  modified_base (387)..(387): a, c, t, g, unknown or other
  misc_feature (387)..(387): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (450)..(451): a, c, t, g, unknown or other
  misc_feature (450)..(451): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (460)..(461): a, c, t, g, unknown or other
  misc_feature (460)..(461): n is a, c, g, or t
  modified_base (463)..(463): a, c, t, g, unknown or other
  misc_feature (463)..(463): n is a, c, g, or t
  modified_base (465)..(466): a, c, t, g, unknown or other
  misc_feature (465)..(466): n is a, c, g, or t
  modified_base (468)..(481): a, c, t, g, unknown or other
  misc_feature (468)..(481): n is a, c, g, or t
tcagtagtgtagatcacgaccggtgctcgatttagtgtgagtagtttgggtttgggggctttgtctgggtctcctggacagtcgatcaccatcccctgcactcggaaccagtagtgacgttggatgattatgactatgtctcctggtttcaacaacacccagacaaagcccccaaactcatcatttttgaggtcactaatcggcctcaggaatttcttctcggcttctctgcctccaagtctggcaacacggcctccttgaccatctctggctccagactgaggacgacgctgattattactgcagttcatatagaggcgaccacacttatgtccttcggaagtgggaccaaggtcgtcgtcctaagtcagcccaaggccaaccccntgtccactctgttcccgccctcctcatcctacactactgagcggctggcaaggcncatagnanntcnncntgnngnanngnnnnnnnnnnnnnn

SEQ ID NO: 177008 - DNA, 448 bp, Homo sapiens
  misc_feature: GYAE6OF02HH72L.37.78.H01.1.454.CMB.1.raw
  modified_base (443)..(448): a, c, t, g, unknown or other
  misc_feature (443)..(448): n is a, c, g, or t
tcagtagtgtagatcacgaccggtgctcgatttagtgtgagtagtttgggtttggggctttgtctgggtctcctggacagtcgatcaccatcccctgcactggaaccagtagtgacgttgatgattatgactatgtctcctggtttcaacaacacccagacaaagcccccaaactcatcattttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggccaaccccactgtcactctgttcccaccctcctcatctacactactgagcggctggcaaggcgcatagnnnnnn

SEQ ID NO: 177009 - DNA, 484 bp, Homo sapiens
  misc_feature: GYAE6OF02GP8XM.37.78.H01.1.454.CMB.1.raw
  modified_base (393)..(393): a, c, t, g, unknown or other
  misc_feature (393)..(393): n is a, c, g, or t
  modified_base (450)..(450): a, c, t, g, unknown or other
  misc_feature (450)..(450): n is a, c, g, or t
  modified_base (456)..(484): a, c, t, g, unknown or other
  misc_feature (456)..(484): n is a, c, g, or t
tcagtagtgtagatcacgaccggtgctcgatttagtgtgagtagtttgggtttgggggcgtttgtctgggtctcctggacagtcgatcaccatcccctgcactggaaccagtagtgacgttgatgattatgactatgtctcctggttttcaacaacacccagacaaagcccccaaactcatcatttttgaggtcactaatcggccctcaggaatttcttctcggctttctctgcctccgaagtctggcaacacggcctccttgaccatctctgggctccagactgaggacgaggctgattattactgcagttcatatagaggcgaccacacttatgtcttcggaagtgggaccaaggtctcgtcctaagtcagcccaagggcccaaaccccgntgtccactctgttccccgccctcctcatctacactactcgagcgggctggcaaggcncatagnnnnnnnnnnnnnnnnnnnnnnnnnnnnn

SEQ ID NO: 177010 - DNA, 498 bp, Homo sapiens
  misc_feature: GYAE6OF02GBL7F.37.78.H01.1.454.CMB.1.raw
  modified_base (398)..(398): a, c, t, g, unknown or other
  misc_feature (398)..(398): n is a, c, g, or t
  modified_base (455)..(455): a, c, t, g, unknown or other
  misc_feature (455)..(455): n is a, c, g, or t
  modified_base (462)..(466): a, c, t, g, unknown or other
  misc_feature (462)..(466): n is a, c, g, or t
  modified_base (468)..(469): a, c, t, g, unknown or other
  misc_feature (468)..(469): n is a, c, g, or t
  modified_base (471)..(472): a, c, t, g, unknown or other
  misc_feature (471)..(472): n is a, c, g, or t
  modified_base (474)..(476): a, c, t, g, unknown or other
  misc_feature (474)..(476): n is a, c, g, or t
  modified_base (478)..(479): a, c, t, g, unknown or other
  misc_feature (478)..(479): n is a, c, g, or t
  modified_base (481)..(484): a, c, t, g, unknown or other
  misc_feature (481)..(484): n is a, c, g, or t
  modified_base (486)..(487): a, c, t, g, unknown or other
  misc_feature (486)..(487): n is a, c, g, or t
  modified_base (490)..(490): a, c, t, g, unknown or other
  misc_feature (490)..(490): n is a, c, g, or t
  modified_base (492)..(495): a, c, t, g, unknown or other
  misc_feature (492)..(495): n is a, c, g, or t
  modified_base (497)..(497): a, c, t, g, unknown or other
  misc_feature (497)..(497): n is a, c, g, or t
tcagtagtgtagatcacgaccggtgctcgatttagtgtgagtagtttgggtttggggggcgtttgtctggggtctcctggacagtcgagtcaccatccccctgcacctgggaacccagtacgtgacgttcgatgatttatgactatgtctcctggtttcaacaacacccagacaaagcccccaaactcatcatttttgaggtcactaatccggcctcaggatttctctcgcttctctgcctccaagtctggcaacacggcctccttgacctatctctgggctccagactgaggaccgaggctgattattactgcagttcatatagaggcgaccgactacttatgtcttcggaagtgggaccaaggtcgtcgtcctaagtcagcccaaggcccaacccntgtcactcgtcgtcccgcctctcatcgtacactactgacgtcggtctcggcaaggcncagtagnnnnngnngnngnnncnngnnnngnngcngnnnncnc

SEQ ID NO: 177011 - DNA, 452 bp, Homo sapiens
  misc_feature: GYAE6OF02IZRAI.37.78.H01.1.454.CMB.1.raw
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
  modified_base (441)..(452): a, c, t, g, unknown or other
  misc_feature (441)..(452): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgctttctctgcctccaagtctggcaacacggcctcctgaccatctctggctccagactgaggacgaggctgattattactgctgctcatatgcaggtatcacttcttatgtcttcggaatgggaccaaggtcacgtctaagcagccaaggcccaaacccntcgtcactctcgtcccnccctcctcatcctacactactgagcgggctggcaggcncatagnnnnnnnnnnnn

SEQ ID NO: 177012 - DNA, 528 bp, Homo sapiens
  misc_feature: GYAE6OF02IZ86F.37.78.H01.1.454.CMB.1.raw
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagtagtgtagatcacgaccggtgctcgatttagtgtgagtagtttgggtttggggctttgtctgggtctcctggacagtcgatcaccatcccctgcactggaaccagtagtgacgttgatgattatgactatgtctcctggttttcaacaacacccagacaaagcccccaaactcatcatttttgaggtcactaatcggccctcaggaatttcttctcgcttctctgcctccaagtctggcaacacggcctcctgaccatctctgggctccagactgaggacgaggctgattattactgcagttcatatagaggcgaccacacttatcgtcttcgggaagttcgggaacctaaggtccgtcgtcctaagtcacgcccaaggcccaacccactcgtacactctcgttccccacccttcctacattcctaactactactgacgcgggtctggcaacggcactagtacgcncagctgtcngcntcgntgtcntcgcncntcacgtcncgtcgtgtacgctacgtgtacg

SEQ ID NO: 177013 - DNA, 461 bp, Homo sapiens
  misc_feature: GYAE6OF02GY360.37.78.H01.1.454.CMB.1.raw
  modified_base (441)..(441): a, c, t, g, unknown or other
  misc_feature (441)..(441): n is a, c, g, or t
  modified_base (447)..(461): a, c, t, g, unknown or other
  misc_feature (447)..(461): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccctgaccatctctgggctccaggctgacgacgaggctcactattattgcagctcatatacaagcagcatcacttgggtgttcggcggagggaccgactcgaccgtcttaggtcagcccaaggctcgccccctcggtcactctcgtccccaccctcctcatctacactactgacgcggctggcaggcncatagnnnnnnnnnnnnnnn

SEQ ID NO: 177014 - DNA, 468 bp, Homo sapiens
  misc_feature: GYAE6OF02IWRS5.37.78.H01.1.454.CMB.1.raw
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (449)..(468): a, c, t, g, unknown or other
  misc_feature (449)..(468): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggcctcaggaatttcttctcgcttctctgcctccaagtctggcaacacggcctccttgaccatctctgggctccagactgaggacgaggctgattattactgcagttcatatagaggcgacacacttatgtcttcggaagtgggaccaaggtcgtcgtcctaagtccagcccaaggcccaacccnctcgtcactctcgtccccacctcctcatctacnctactgacgcggctcggcaaggcgacatacgnnnnnnnnnnnnnnnnnnnn

SEQ ID NO: 177015 - DNA, 720 bp, Homo sapiens
  misc_feature: GYAE6OF02HGSTA.37.78.H01.1.454.CMB.1.raw
  modified_base (718)..(718): a, c, t, g, unknown or other
  misc_feature (718)..(718): n is a, c, g, or t
tcagtagtgtagatcacgaccggtgctcgatttagtgtgagtagtttggggtttgggggcttgtctgggtctccgtggacagtcgatccaccattccccgtcgcacgtacggaaccaggtaaccgtgacgttgatgtattattcgaccttatgttcctcccttgggtttccaaccaacaaccccaacgaaccgaaaagacccccctaaacgttctatcctatttttggacggttccacgtaactccggtcccttctaggtaactttccttacggtacgcttcctccttgccctcgaacgtcgtcggacaacacggtccttccttgaccatcctcgtcgggtcctccgacgtacgtcgaggaccgaggacctggacttaagttacctcgcgtacgttccatattacggacggtccgaacccactaccttaagtcgtacggttaccggaagtcggggaacctaacgggtcccgtacgtacctaaggttccaggtacccgaacggtacccaaacccggtcgttacggtacctacctttccttaccgtttccccctacccttccctactactacctacctacgtacgtcggacggtccgggttactagggtaccttaacgggcgtacgtaagttacggactgtacacgctgtacctaggactacacttctacgtcttccgccggttagacctaagtcgtaatacacgtaagtacgtgtacgnac

SEQ ID NO: 177016 - DNA, 536 bp, Homo sapiens
  misc_feature: GYAE6OF02GD5A9.37.78.H01.1.454.CMB.1.raw
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (505)..(507): a, c, t, g, unknown or other
  misc_feature (505)..(507): n is a, c, g, or t
  modified_base (509)..(510): a, c, t, g, unknown or other
  misc_feature (509)..(510): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (517)..(519): a, c, t, g, unknown or other
  misc_feature (517)..(519): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (535)..(536): a, c, t, g, unknown or other
  misc_feature (535)..(536): n is a, c, g, or t
tcagtagtgtagatcacgaccggtgctcgatttagtgtgagtagtttgggtttgggggctttagtctcgggtctccgtggacacgtcgatcaccatcccctgcactggaaccagtagtgacgttgatgatttatgactatgtctcctggtttcaacaaccacccacgacaaacgcccccaaactcatcatttttggaggtcactaatcggccctcaggaatttcgtctcgcttctctgcctccaagtctggcaacaccggccttccttgaccatctctgggctcagactggacggacgaggctgattattacgtgcagtttcattataggaggccgtaaccactacctttatgtcttacgggaagttggggaccaagggtcgtcgtcctaagtcagccaagcccaacccntcgcactctcgttccccnccctccncactctaccactacgtcgacggcgggcttcgggcaagggtcgactagttaggcncgcncgtnactncgtnnngnngngtntnnntntntncngngcgcgnn

SEQ ID NO: 177017 - DNA, 459 bp, Homo sapiens
  misc_feature: GYAE6OF02GCW5E.37.78.H01.1.454.CMB.1.raw
  modified_base (449)..(459): a, c, t, g, unknown or other
  misc_feature (449)..(459): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggcccaaccccactgtcactctgttccccgccctcctcatctacactactgacgcgggctggcaaggcgcatagnnnnnnnnnnn

SEQ ID NO: 177018 - DNA, 460 bp, Homo sapiens
  misc_feature: GYAE6OF02GVOT1.37.78.H01.1.454.CMB.1.raw
  modified_base (449)..(460): a, c, t, g, unknown or other
  misc_feature (449)..(460): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtctaagtcagcccaaggcccaacccactcgtcactctcgttcccgccctcctcactcctacactactgagcgggctggcaaggcgcatagnnnnnnnnnnnn

SEQ ID NO: 177019 - DNA, 453 bp, Homo sapiens
  misc_feature: GYAE6OF02FRIX9.37.78.H01.1.454.CMB.1.raw
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (447)..(453): a, c, t, g, unknown or other
  misc_feature (447)..(453): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcagcccaaggcccaaccccactgtcactctgttcccgccctccncatctacnctactgagcgggctggcaaggcgcatagnnnnnnn

SEQ ID NO: 177020 - DNA, 460 bp, Homo sapiens
  misc_feature: GYAE6OF02IAV0A.37.78.H01.1.454.CMB.1.raw
  modified_base (448)..(460): a, c, t, g, unknown or other
  misc_feature (448)..(460): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagagcgaccacacttatgtcttcggaagtgggaaccaagggtcgtcgtcctaagtcagcccaggcccaacccactgtcactctcgttcccgccctctcatctacactactgagcggctggacaaggcgcaatacgnnnnnnnnnnnnn

SEQ ID NO: 177021 - DNA, 455 bp, Homo sapiens
  misc_feature: GYAE6OF02IF27N.37.78.H01.1.454.CMB.1.raw
  modified_base (428)..(428): a, c, t, g, unknown or other
  misc_feature (428)..(428): n is a, c, g, or t
  modified_base (450)..(455): a, c, t, g, unknown or other
  misc_feature (450)..(455): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaattttcttctcgcttctctgcctccaagtctggcaacacggcctccttgaccatctctgggctccagactgaggacgaggctgattattactgcagttcatatagaggcgaccacacttatgtcttcggaagtgggaccaagggtcgtcgtcctaagtcagcccaaggcccaaaccccatcgtccactctcgttcccgccctcctcatctacactacngagcggctggcaaggcgcatgnnnnnn

SEQ ID NO: 177022 - DNA, 471 bp, Homo sapiens
  misc_feature: GYAE6OF02I6JW7.37.78.H01.1.454.CMB.1.raw
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (455)..(471): a, c, t, g, unknown or other
  misc_feature (455)..(471): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacactttatgtcttacggaagtcggaacctaaggtcgtcgtactaagtcacgcccaaggcccaaaccccatcgtccactcctcgttccccgcctcctcactcacactactgacgcggctggcaggcncanagnnnnnnnnnnnnnnnnn

SEQ ID NO: 177023 - DNA, 475 bp, Homo sapiens
  misc_feature: GYAE6OF02I5RI7.37.78.H01.1.454.CMB.1.raw
  modified_base (446)..(446): a, c, t, g, unknown or other
  misc_feature (446)..(446): n is a, c, g, or t
  modified_base (452)..(475): a, c, t, g, unknown or other
  misc_feature (452)..(475): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctggctccagactgaggacgaggctgattattactgcagttcatatagaggcgaccacacttatgtcttcggaagtggaccaaggtcgtcgtcctaagtcacgcccaaaggcccaaaccccactgtacactctcgttccccgccctcctcactctacactactcgagcggctggcaaggcnatagcnnnnnnnnnnnnnnnnnnnnnnnn

SEQ ID NO: 177024 - DNA, 461 bp, Homo sapiens
  misc_feature: GYAE6OF02H97FQ.37.78.H01.1.454.CMB.1.raw
  modified_base (444)..(444): a, c, t, g, unknown or other
  misc_feature (444)..(444): n is a, c, g, or t
  modified_base (450)..(461): a, c, t, g, unknown or other
  misc_feature (450)..(461): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagacctgaggacgaggctgattattactgcagttcatatagaggcgaccacacttatgtcttcggaagtgggaccaaggtcgtcgtcctaagtcagcccaaggccaaccccactgtccactctcgttcccacccctcctcatctacactactgagccggctggcaaggcncatagnnnnnnnnnnnn

SEQ ID NO: 177025 - DNA, 683 bp, Homo sapiens
  misc_feature: GYAE6OF02ICQ1J.37.78.H01.1.454.CMB.1.raw
  modified_base (625)..(625): a, c, t, g, unknown or other
  misc_feature (625)..(625): n is a, c, g, or t
  modified_base (639)..(639): a, c, t, g, unknown or other
  misc_feature (639)..(639): n is a, c, g, or t
  modified_base (679)..(679): a, c, t, g, unknown or other
  misc_feature (679)..(679): n is a, c, g, or t
tcagtagtgtagatcacgaccggtgctcgatttagtgtgagtagtttgggtttgggggtctttggtctgggtctcctggacagtcgactcaccatcccctgccactggaaccagtagtgacgttgatcgattatgactatgtctcctggtttcaaccaacaccctagacaaagcccccaaactcatcactttttgaggtcactaatcggtccctcagggtaatttcgttcgtccggcttcgtcctggccgtccaaggttctggacaacgacggtccttccttgaccctattccttcgtcgggtcctcctagaacttcggaggacggaggctgattattactcgctagttcatagtaggacggtccgaccactacttatcgttccttacgggaagtgggaacctaagggttccgttacggtaccttaacggtctacggaccccgtaaagggccccctaaaccccgtcttacggtaccaccgttccgtacggttacccctacccccgttccttaccgtacttaccgttaacctaaccgttaaccgttcggtacggtacccggggtaccttcgggtaccgtaaacggggtccgaccggtaacgttaaccggcgacgcaggatccgtancgtcgacttcaccncgctacgtctctcgcgtctcgtcgtctcctacgtctacgngtcg

SEQ ID NO: 177026 - DNA, 537 bp, Homo sapiens
  misc_feature: GYAE6OF02JC673.37.78.H01.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (491)..(491): a, c, t, g, unknown or other
  misc_feature (491)..(491): n is a, c, g, or t
tcagtagtgtagatcacgaccggtgctcgatttagtgtgagtagtttgggtttggggggctttgtactgggtctcctggacagtcgatcaccatcccctgcactggaaccgacgtagtgacgttgatcgagttatcgactatgtctcctggtttcaacaacaccagacaaagccccaaactcatcatttttgacggtcactaatcggccctccaggaatttcttctcgcttctctgcctcaagtctggcaacacggcctctcgccatctnggctcagactgagcgnggctnattatactgctagttcatatagaggcgaccacacttatgtccttcggaagtcggaccaagggtcgtccgtacctaagtctacgccgaggacccaacccgactacgtccacgtctcgttcccacctctcactctacnctacncgagccggtcncggacacggccgacattaggnatactntacgctaagacatacgtctcnctctcgtcgtcgacgacgtacgacgacgacacgacgactacgtgcg

SEQ ID NO: 177027 - DNA, 474 bp, Homo sapiens
  misc_feature: GYAE6OF02HDVFK.37.78.H01.1.454.CMB.1.raw
  modified_base (360)..(360): a, c, t, g, unknown or other
  misc_feature (360)..(360): n is a, c, g, or t
  modified_base (443)..(443): a, c, t, g, unknown or other
  misc_feature (443)..(443): n is a, c, g, or t
  modified_base (449)..(474): a, c, t, g, unknown or other
  misc_feature (449)..(474): n is a, c, g, or t
tcagtagtgtagatcacgaccggtgctcgatttagtgtgagtagtttgggtttgggggctttgtctgggtctcctggacagtcgatcaccatcccctgcactggaaccagcagtgatattgaaacttataaccttgtctcttggtaccaacagcacccaggcaaagcccccaaactcatgatttgtgaggacagtaagcggccctcaggggtctctaatcgcttctctggctccaagtctggcaacacggcctccctgaccatctctgggctccaggctgacgacgaggctcactattattgcagctcatatacaagcagcgtcacgttgggtgttcggcggaggaccgacctgaccgtnttaggtcacgcccaaggctcgccccctggtcactctcgttcccaccctctcatcacactactgagcgggctcgggcaaggtcncatagnnnnnnnnnnnnnnnnnnnnnnnnnn

SEQ ID NO: 177028 - DNA, 464 bp, Homo sapiens
  misc_feature: GYAE6OF02G82EZ.37.78.H01.1.454.CMB.1.raw
  modified_base (322)..(322): a, c, t, g, unknown or other
  misc_feature (322)..(322): n is a, c, g, or t
  modified_base (445)..(445): a, c, t, g, unknown or other
  misc_feature (445)..(445): n is a, c, g, or t
  modified_base (451)..(464): a, c, t, g, unknown or other
  misc_feature (451)..(464): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctctgaccatctctgggctccagactgaggacgaggctgattattactgcagttcatatagaggcgaccanacttatgtcttcggaagtcgggaccaagggtcgtcgtcctaagtcagacccgaaggcccaaccccatcgtccactttcgtccccgccctcctcatctacactactgacgcggctggcaaggcncatagnnnnnnnnnnnnnn

SEQ ID NO: 177029 - DNA, 454 bp, Homo sapiens
  misc_feature: GYAE6OF02G3PM2.37.78.H01.1.454.CMB.1.raw
  modified_base (446)..(446): a, c, t, g, unknown or other
  misc_feature (446)..(446): n is a, c, g, or t
  modified_base (450)..(454): a, c, t, g, unknown or other
  misc_feature (450)..(454): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccacacttatgtcttcggaagtgggaccaaggtcgtcgtcctaagtcacgcccaaggcccaaccccactcgtccactctcgttccccgccctcctcatcctacactactgacgcggctggcaggcnatgnnnnn

SEQ ID NO: 177030 - DNA, 453 bp, Homo sapiens
  misc_feature: GYAE6OF02G2WD9.37.78.H01.1.454.CMB.1.raw
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (436)..(453): a, c, t, g, unknown or other
  misc_feature (436)..(453): n is a, c, g, or t
tcagtagtgtagatcacgaccggtgctcgatttagtgtgagtagtttgggtttgggggctttgtctgggtctcctggacagtcgatcaccatcccctgcactggaacccgcagtgacgttggtggttataactatgtctcttggtaccaacatcacccaggcaaagtccccaaaactcatgatttatgaggtcactaaacggccctcaggggtctctaatcgcttctctggctccaagtctggcaacacggcctccctgacaatctctgggctccaggctgaggacgaggctgattattactgctgctcatatgcaggtatcactcttatgtctcggaactgggacagtccacgtcctaagtcagccaaggccaacccntcgtcactctctcccaccctcncactctacactactgagcggctggcaagcncangnnnnnnnnnnnnnnnnnn

SEQ ID NO: 177031 - DNA, 474 bp, Homo sapiens
  misc_feature: GYAE6OF02FE9L4.37.78.H01.1.454.CMB.1.raw
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (454)..(474): a, c, t, g, unknown or other
  misc_feature (454)..(474): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatagaggcgaccanactttangtcttcggaagtggggaccaaggtcgtcgtcctaagtcagcccaaaggcccaaaccccactgtccactctgttcccaccctcctcatcctacactactgacgcgggctggcaaggcgcatagnnnnnnnnnnnnnnnnnnnnn

SEQ ID NO: 177032 - DNA, 476 bp, Homo sapiens
  misc_feature: GYAE6OF02JZYQM.37.78.H01.1.454.CMB.1.raw
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (461)..(476): a, c, t, g, unknown or other
  misc_feature (461)..(476): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggtaatttcttctcgcttctctgcctccaagtctggcaacacggcctccttgaccatctctgggctccagactgaggacgaggctgattattactgctagttcatataggaggcgaaccactacttatgttcgttacggaagtggggaaccaagggtcgtcgtcctaagtcagcccaaggcccaacccncgtgcnctctcgttccccaccctctacactcctacactactgacgcggctggacaaggcacagannnnnnnnnnnnnnnn

SEQ ID NO: 177033 - DNA, 595 bp, Homo sapiens
  misc_feature: GYAE6OF02H2PKY.37.78.H01.1.454.CMB.1.raw
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(588): a, c, t, g, unknown or other
  misc_feature (575)..(588): n is a, c, g, or t
  modified_base (590)..(595): a, c, t, g, unknown or other
  misc_feature (590)..(595): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatctatttttgaggtcactaatcggccctcaggaatttcttctcgcttctctgcctccaagtctggcaacacggcctccttgaccatctctgggctccagactgaggacgnggctgattattacngcatttcatagtagacggcgaaccctactacttatcggttaccttcggggaaacgtggggaaccctaagggttcgttaccggttacctaacgttccgaacggtaccccgaaagggacccccaaaacccccacgttccgtacctaaccgttccgttaccgtttcccccggccccttacccgtccacttaccttaacctaccgttactacggacggtccgggccgtaggaccgaaacgggtcccgaacgtacgttagacngtacncncntncncnnnnnnnnnnnnnncnnnnnn

SEQ ID NO: 177034 - DNA, 553 bp, Homo sapiens
  misc_feature: GYAE6OF02IK89G.37.78.H01.1.454.CMB.1.raw
  modified_base (529)..(533): a, c, t, g, unknown or other
  misc_feature (529)..(533): n is a, c, g, or t
  modified_base (535)..(553): a, c, t, g, unknown or other
  misc_feature (535)..(553): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatatgaggcgacacacttatgtcttcggaagtcggacctaagggtcgtacgtacctaagtcacgacccaaaggacccaaacccctctcgtcctaaccttccttaccggtttcccccaacccccgtccttacccaacttaccttaaacctaaccgttaaccgtaggaccgggccgggtcgttacgggaccgtaaacgggccaccgtaagtacgcagtcactnnnnncnnnnnnnnnnnnnnnnnnn

SEQ ID NO: 177035 - DNA, 470 bp, Homo sapiens
  misc_feature: GYAE6OF02GQ5BL.37.78.H01.1.454.CMB.1.raw
  modified_base (451)..(451): a, c, t, g, unknown or other
  misc_feature (451)..(451): n is a, c, g, or t
  modified_base (457)..(470): a, c, t, g, unknown or other
  misc_feature (457)..(470): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatataggaggcgaccactacttatgtcttcggaagtgggaaccaaggtcgtcgtcctaagtcagcccaaggcccaaccccactcgtcactctcgttaccccaccctcctcactcctacactactgacgccgggctggcaggcncatagnnnnnnnnnnnnnn

SEQ ID NO: 177036 - DNA, 497 bp, Homo sapiens
  misc_feature: GYAE6OF02HRATN.37.78.H01.1.454.CMB.1.raw
  modified_base (454)..(454): a, c, t, g, unknown or other
  misc_feature (454)..(454): n is a, c, g, or t
  modified_base (459)..(460): a, c, t, g, unknown or other
  misc_feature (459)..(460): n is a, c, g, or t
  modified_base (462)..(462): a, c, t, g, unknown or other
  misc_feature (462)..(462): n is a, c, g, or t
  modified_base (466)..(468): a, c, t, g, unknown or other
  misc_feature (466)..(468): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(483): a, c, t, g, unknown or other
  misc_feature (481)..(483): n is a, c, g, or t
  modified_base (485)..(486): a, c, t, g, unknown or other
  misc_feature (485)..(486): n is a, c, g, or t
  modified_base (488)..(492): a, c, t, g, unknown or other
  misc_feature (488)..(492): n is a, c, g, or t
  modified_base (494)..(494): a, c, t, g, unknown or other
  misc_feature (494)..(494): n is a, c, g, or t
  modified_base (496)..(497): a, c, t, g, unknown or other
  misc_feature (496)..(497): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagccccaaactcatcatttttgaggtcactaatcggcctcaggaatttctctcgcttctctgcctccaagtctggcaacacggcctcttgaccatctcgtggctccgagactgaggacgaggctgattatactgcagttcatataggacgcgaccactacttatgtcttcggaagtcggaactaggtctcgtacctaagtcagccgaagcccaacccatcgtacactctcgttccccgcctcctcacttcctacactactgacgcggctcggactaacggcgacagtagntacgnngnacgnnncncncgngngngnnngnngnnnnncncnn

SEQ ID NO: 177037 - DNA, 499 bp, Homo sapiens
  misc_feature: GYAE6OF02GEU8F.37.78.H01.1.454.CMB.1.raw
  modified_base (246)..(246): a, c, t, g, unknown or other
  misc_feature (246)..(246): n is a, c, g, or t
  modified_base (409)..(409): a, c, t, g, unknown or other
  misc_feature (409)..(409): n is a, c, g, or t
  modified_base (485)..(499): a, c, t, g, unknown or other
  misc_feature (485)..(499): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccagtctggcaacncggcctccttgaccatctctggcctcagactgaggacgaggctgattattactgcagttcatataggaggccgaaccactacttagtcgttcgttacgggtaaggtcggggaacctagggtccgtcgttacctaagtcacgaccccgaaggccccaaaccccnctcgtcctactctcgttcccccacctcctacactcctacactacgtcgacgtcgggtctggacagggcacagtagnnnnnnnnnnnnnnn

SEQ ID NO: 177038 - DNA, 490 bp, Homo sapiens
  misc_feature: GYAE6OF02IW1RZ.37.78.H01.1.454.CMB.1.raw
  modified_base (406)..(406): a, c, t, g, unknown or other
  misc_feature (406)..(406): n is a, c, g, or t
  modified_base (470)..(470): a, c, t, g, unknown or other
  misc_feature (470)..(470): n is a, c, g, or t
  modified_base (476)..(490): a, c, t, g, unknown or other
  misc_feature (476)..(490): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaactcatctatttttgaggtcactaatcggccctcaggaatttctctcgcttctctgcctccaagtctggcaacacggcctcctgaccatctctggctccagactgaggacgaggctgattattactgctagttcatataggaggccgaccactactttatcgttacgttcgggaagttcggggacctaagggtccgtacgttacctaagtcacgacccaaggcccaaccccntcgtaccactctcgtccccgccctcctcacttcctacactactgacgcggtctggacaggcganacgtgnnnnnnnnnnnnnnn

SEQ ID NO: 177039 - DNA, 479 bp, Homo sapiens
  misc_feature: GYAE6OF02HBE5K.37.78.H01.1.454.CMB.1.raw
  modified_base (247)..(247): a, c, t, g, unknown or other
  misc_feature (247)..(247): n is a, c, g, or t
  modified_base (324)..(324): a, c, t, g, unknown or other
  misc_feature (324)..(324): n is a, c, g, or t
  modified_base (389)..(389): a, c, t, g, unknown or other
  misc_feature (389)..(389): n is a, c, g, or t
  modified_base (459)..(479): a, c, t, g, unknown or other
  misc_feature (459)..(479): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacncggcctccttgaccatctctgggctccagactgaggacgaggctgattattactgcagttcatatagaggcgaccanacttatgtctcggaagtggaaccaaggtcgtcgtacctaagtcacgcccaacggcccaaaccccnctgtccacttcctcgttccccgccctcctctactcctacactactgaggcgggctggcaaggcgcagagnnnnnnnnnnnnnnnnnnnnn

SEQ ID NO: 177040 - DNA, 493 bp, Homo sapiens
  misc_feature: GYAE6OF02JCNBP.37.78.H01.1.454.CMB.1.raw
  modified_base (302)..(302): a, c, t, g, unknown or other
  misc_feature (302)..(302): n is a, c, g, or t
  modified_base (467)..(468): a, c, t, g, unknown or other
  misc_feature (467)..(468): n is a, c, g, or t
  modified_base (471)..(471): a, c, t, g, unknown or other
  misc_feature (471)..(471): n is a, c, g, or t
  modified_base (473)..(493): a, c, t, g, unknown or other
  misc_feature (473)..(493): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgacggacgaggctgattattacngcagttcatatagaggccgacacacttatgtcttacggagtggaccaaggtcgtcgtctaagtcagcccaaggcccaaaccccatcgtaccacttccgtgttccccgccctcctccactcctacactactgacgccgggtctcggacgaacgggcgcagtaagcnncangnnnnnnnnnnnnnnnnnnnnn

SEQ ID NO: 177041 - DNA, 470 bp, Homo sapiens
  misc_feature: GYAE6OF02JJ0O7.37.78.H01.1.454.CMB.1.raw
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
  modified_base (452)..(470): a, c, t, g, unknown or other
  misc_feature (452)..(470): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctccttgaccatctctgggctccagactgaggacgaggctgattattactgcagttcatagtagaggcgaccacacttatcgtctcggaagtgggaccaaggtcgtcgtcctagtcagcccaagcccaaccccngtcgtcactctcgttacccacctcctcactctaccnctactcgagcgggctcggcaggcgtcatagnnnnnnnnnnnnnnnnnnn

SEQ ID NO: 177042 - DNA, 469 bp, Homo sapiens
  misc_feature: GYAE6OF02IC9AA.37.78.H01.1.454.CMB.1.raw
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(469): a, c, t, g, unknown or other
  misc_feature (445)..(469): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcattttttgaggtcactaatcggccctcaggaatttcttctcgcttctctgcctccaagtctggcaacacggcctccttgaccatctctgggctccagactgaggacgaggctgattattactgctagttcatatagaggcgaccacacttatgtcttcggaagtggacaagtcgtcgtctagcagcccaggccaacccntcgcactctgtcccnccctcctcactctacactactgancgggctggcaaggcgcagtagnagncnnnnnnnnnnnnnnnnnnnnnnnnn

SEQ ID NO: 177043 - DNA, 536 bp, Homo sapiens
  misc_feature: GYAE6OF02IXNEV.37.78.H01.1.454.CMB.1.raw
  modified_base (199)..(199): a, c, t, g, unknown or other
  misc_feature (199)..(199): n is a, c, g, or t
  modified_base (406)..(406): a, c, t, g, unknown or other
  misc_feature (406)..(406): n is a, c, g, or t
  modified_base (509)..(536): a, c, t, g, unknown or other
  misc_feature (509)..(536): n is a, c, g, or t
tcagtagtgtagatcacgaccggtgctcgatttagtgtgagtagtttgggtttgggggctttgtctgggtctcctggacagtcgatcaccatcccctgcactggaacagtagtgacgttgatgattatgactatgtctcctggtttcaacaacaccagaacaaacgacccccaaactcatctatttttgagtcactaancggcctcagtatttcttctcgcttctctgcctccaagtcgtggacaaccacggccttcctgacctctcctcgtcggctccagacgtagaggacggtaggctagattacttactgctagtcatagtaggacgcgaccactacttatcgtcgttaggagtcgggaacctaggtcctcgtactagtcaccgccgaacggacccaaccccngtcgtcctacttccgtttccggttacccctcccttccctactacgttacctactaccttacgtggacggtcgggtactcgggaacgtacgggccatagtagcnnnnnnnnnnnnnnnnnnnnnnnnnnnn

SEQ ID NO: 177044 - DNA, 691 bp, Homo sapiens
  misc_feature: GYAE6OF02GATC3.37.78.H01.1.454.CMB.1.raw
  modified_base (377)..(377): a, c, t, g, unknown or other
  misc_feature (377)..(377): n is a, c, g, or t
  modified_base (624)..(624): a, c, t, g, unknown or other
  misc_feature (624)..(624): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (642)..(642): a, c, t, g, unknown or other
  misc_feature (642)..(642): n is a, c, g, or t
  modified_base (665)..(665): a, c, t, g, unknown or other
  misc_feature (665)..(665): n is a, c, g, or t
  modified_base (683)..(683): a, c, t, g, unknown or other
  misc_feature (683)..(683): n is a, c, g, or t
tcagtagtgtagatcacgaccggtgctcgattttagtgtgagtagtttgggttttgggggcgtttgtactagggtctcctggacagtcgatcaaccagtcccctgcaacctggaaccacgtagtcgaacgttgactgacttagtgactatgtctccgtggttcaacaacaccagacaaagccccaaactcactcgatttttgaggtcacgttaatccggccttcgaggtaacttttcgttacgtcgacttctcgtcggcctccaagtctggccacgacggcctcgttcgactacgtctcgtacggtcctccgagtacgtcgtaacggacgtagggctgtattacgtaccgtgacgtacgttacaacgttagtacggnggtaccgaccgtactaacgttacgttacgttacgtacggtaaggtcggaacgtaacgggttcgtcgttaccgtaacgttacgacgtacccgaacgggtaccccaaacccgtacttacggacctaccgttaccgtaccggttcccccgcccttaccgtaaccgtaacttacctaacctaacgttaaccgttaggacgggttacggtcgtacggaacggtaaccgtcgaacttagtcgacacgacgacnctcatcgnagtncgtacngaacgtgactggaacttcgaacncgggactacggcgttacncgtacgcg

SEQ ID NO: 177045 - DNA, 582 bp, Homo sapiens
  misc_feature: GYAE6OF02GK2DK.37.78.H01.1.454.CMB.1.raw
  modified_base (553)..(553): a, c, t, g, unknown or other
  misc_feature (553)..(553): n is a, c, g, or t
  modified_base (559)..(582): a, c, t, g, unknown or other
  misc_feature (559)..(582): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggtaatttcttctcgcttctctgcctccaagtctggcaacacggcctcctgaccatctctgggcctcaggctgaggacgaggctagattattactgctgctcatatgacgtagggtatcacttcttatcgttcttacggaacgtggggaaccctaaggtcccgtaacccgtacccgtaaacggtcctaacggaccccgaaacgggaccccaaaccccctacgtttcgtacctaaccttcccggttcccgtttcccccggccccctttaccgttctaccttaccgtaaccctaccgttaacgtcggtacgggcccgggtacgtcggaaccgacggccgactagtagntcgtannnnnnnnnnnnnnnnnnnnnnnn

SEQ ID NO: 177046 - DNA, 574 bp, Homo sapiens
  misc_feature: GYAE6OF02ICZKD.37.78.H01.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (463)..(463): a, c, t, g, unknown or other
  misc_feature (463)..(463): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (549)..(550): a, c, t, g, unknown or other
  misc_feature (549)..(550): n is a, c, g, or t
  modified_base (552)..(553): a, c, t, g, unknown or other
  misc_feature (552)..(553): n is a, c, g, or t
  modified_base (555)..(574): a, c, t, g, unknown or other
  misc_feature (555)..(574): n is a, c, g, or t
tcagtagtgtagatcacgaccggtgctcgatttagtgtgagtagtttgggtttgggggctttgtctgggtctcctggacagtcgatcacccatcccctgcactggaaccagtagtgacgttgatgattatgactatgtctcctggtttcaacaacacccagacaaacgcccccaaactcatcatttttgagtcactaatcgccctnaggaatttcttctcgcttctctgccttcccaagtcctgganaacacggcctaccttgaccatctntgggctccanactgagcgagcngtattattactgacgagtttcaatatagacggcgaaccctagtaacctttatcgtagtttccggaagtggggtaacccaaagggttccgtccgtactaaacgtcaagtaccccgaaggacccaaaccccctaccttggtaccctaccgttcccttaccgggtttcccccnccccttccgttacacttctaaaccgaccttacttagaggtccggggctacgggtaccgaaaggccggaccaatgancganccgtanncnntnnnnnnnnnnnnnnnnnnnn

SEQ ID NO: 177047 - DNA, 525 bp, Homo sapiens
  misc_feature: GYAE6OF02FVKO4.37.78.H01.1.454.CMB.1.raw
  modified_base (222)..(222): a, c, t, g, unknown or other
  misc_feature (222)..(222): n is a, c, g, or t
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
  modified_base (474)..(474): a, c, t, g, unknown or other
  misc_feature (474)..(474): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (503)..(525): a, c, t, g, unknown or other
  misc_feature (503)..(525): n is a, c, g, or t
tcagtagtgtagatcacgaccggtgctcgatttagtgtgagtagtttgggtttggggggcgtttgtctggggtctcctggacagtcgatcgacctatccccgtgtcactgggaaccagtagtgacgttgatgattatgactatgtctcctggtttcaacaacacccagactaaacgccccccaaactccaattactatttttgaggtcactaatcggccctnaggtatttcttctcgcttcgtctgccttccaagtcgtggccaacgacggcctccttgaccatctctggctcanctgacggcgaggctgacttattacgtgccagttcattagtaggaggccaccactactttgtgtcgttacggaagtgggactaagggtctcgtactagtcacgcccaaggtcccaacccntcgtccacttcgtccgtacccccgccctcctcgattcccaacactacgtgacggccggtntggcaacgggcactaatgcatnancgtannnnnnnnnnnnnnnnnnnnnnn

SEQ ID NO: 177048 - DNA, 473 bp, Homo sapiens
  misc_feature: GYAE6OF02GGPA4.37.78.H01.1.454.CMB.1.raw
  modified_base (299)..(299): a, c, t, g, unknown or other
  misc_feature (299)..(299): n is a, c, g, or t
  modified_base (458)..(473): a, c, t, g, unknown or other
  misc_feature (458)..(473): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctccaagtctggcaacacggcctcttgaccatctctgggctccagactgaggacgagctgattattacngcagttcatataggaggcgaccactacttatgtcttcggaagtcgggaccaaggtccgtcgtcctaagtcagcccaaggcccaaaccccactgtccactctcgttccccgccctcctcactccacactactgacgcgggctaggcaaggcgacagtagnnnnnnnnnnnnnnnn

SEQ ID NO: 177049 - DNA, 564 bp, Homo sapiens
  misc_feature: GYAE6OF02GLV09.37.78.H01.1.454.CMB.1.raw
  modified_base (535)..(535): a, c, t, g, unknown or other
  misc_feature (535)..(535): n is a, c, g, or t
  modified_base (540)..(564): a, c, t, g, unknown or other
  misc_feature (540)..(564): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgccctccaagtctggaccaacacggcctccttgaccatcctctgggctccagactgaggacaggctgattatactgctgttcatatacgaggcgacctaacactttagtactcgttacgggaaggtcggggaaccctaaggggttccgtcgtacctaaagtcgaacggtaccccgaaaggcccccaaaaccccctatggtccctaacttcgtcccgtttcccccgacccctttcccactacgtccctaacctacttacgtcgaccggggtcggccgtcgggtaccaaccgggtcactaagtacgagnagtcnnnnnnnnnnnnnnnnnnnnnnnnn

SEQ ID NO: 177050 - DNA, 471 bp, Homo sapiens
  misc_feature: GYAE6OF02GJOW7.37.78.H01.1.454.CMB.1.raw
  modified_base (323)..(323): a, c, t, g, unknown or other
  misc_feature (323)..(323): n is a, c, g, or t
  modified_base (383)..(383): a, c, t, g, unknown or other
  misc_feature (383)..(383): n is a, c, g, or t
  modified_base (443)..(444): a, c, t, g, unknown or other
  misc_feature (443)..(444): n is a, c, g, or t
  modified_base (446)..(471): a, c, t, g, unknown or other
  misc_feature (446)..(471): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaagccccccaaactcatcatttttgaggtcactaatcggccctcaggaatttcttctcgcttctctgcctccaagtctggcaacacggcctccttgaccatctctgggctccagactgaggacgaggctgattattactgcagttcatatagagcaccanacttatgtcttcggaagtcggaccaggtcgtcgtcctaagtcagcccaaggcccaacccntgccactctcgtcccgccctctcactctacactactgacgcggctcggcaggcgcatagnngnnnnnnnnnnnnnnnnnnnnnnnnnn

SEQ ID NO: 177051 - DNA, 528 bp, Homo sapiens
  misc_feature: GYAE6OF02FSTMG.37.78.H01.1.454.CMB.1.raw
  modified_base (336)..(336): a, c, t, g, unknown or other
  misc_feature (336)..(336): n is a, c, g, or t
  modified_base (490)..(490): a, c, t, g, unknown or other
  misc_feature (490)..(490): n is a, c, g, or t
  modified_base (497)..(498): a, c, t, g, unknown or other
  misc_feature (497)..(498): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (518)..(521): a, c, t, g, unknown or other
  misc_feature (518)..(521): n is a, c, g, or t
  modified_base (523)..(523): a, c, t, g, unknown or other
  misc_feature (523)..(523): n is a, c, g, or t
  modified_base (525)..(528): a, c, t, g, unknown or other
  misc_feature (525)..(528): n is a, c, g, or t
tcagtagtgtagatcacgaccggtgctcgatttagtgtgagtagtttgggtttgggggctttgtctgggtctcctggacagtcgatcaccatctcctgcactggaaccagcagtgatattgaaacttataaccttgtctcttggtaccaacagcacccaggcaaagcccccaaaactcatgatttgtgaggacagtaagcggccctcaggggtttctaatcgcttctctggcctccaagtctggcaacacggcctccctgacaatctctgggcctcaggctgaggacgaggctgtagttattactgctcgctacatatgctacggtagtactactnttatcgttcttcggaactgggaccaaggtcaaccgtctaagtcacgcccaaggcccaaccccactgtaccacttctaccggttccccaccccttctcctatacctacctacctactcgacggcggctacgggacacgggccgactaacgtagcnctagctnntnacnacgnangcntacnannnncngnnnn

SEQ ID NO: 177052 - DNA, 691 bp, Homo sapiens
  misc_feature: GYAE6OF02FNV00.37.78.H01.1.454.CMB.1.raw
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (330)..(330): a, c, t, g, unknown or other
  misc_feature (330)..(330): n is a, c, g, or t
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggttcaacaacacccagacaaagcccccaaactcatcattttgaggtcactaatccggccctnaggtaatttcttctcgcttctctgcctccaagtctggcaacncggcctctcgaccntctcgnggctccgagtactgaggacgtaggctgtaacttattcgtagctaaggttcaagttagtaacgngggacctaacccacgtaactttcgtcggttaccgttacgggtaacggtcgggtaacgtaacggggttccgtaccggttaccgtaaacgtccgaacggaccccgtaaacggggtaccccaaaccccccgtaagttccggtaccaaccgttccgttacccgtttacccccaccccttaccccgtactaaccgttccctaacctaccgttaccgtcggaaccgggtccgggttaccgtacggtaccgtagggaccctaccgaagtcgggtaacnctcggtngtacgtcgtcgtcgtacgacgtacgtacgtcgtcgtactacgtaccgacgtacgtacgacgtacgacgacgacgtacgcgtcg

SEQ ID NO: 177053 - DNA, 693 bp, Homo sapiens
  misc_feature: GYAE6OF02JVAAU.37.78.H01.1.454.CMB.1.raw
  modified_base (550)..(550): a, c, t, g, unknown or other
  misc_feature (550)..(550): n is a, c, g, or t
  modified_base (642)..(642): a, c, t, g, unknown or other
  misc_feature (642)..(642): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (679)..(679): a, c, t, g, unknown or other
  misc_feature (679)..(679): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (692)..(692): a, c, t, g, unknown or other
  misc_feature (692)..(692): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgtttgatgattatgactatgtctcctggtttcaacaacacccagacaaacgacccccaaactccatcctattttttcgaggtacacttaatccggccctacgaggtaactttcttctcgtcttctcttcgccttaccaacgttctggtaccaacgacccggtcccgttccttacgaccctactccgttaccgtcggggtaccttccccaaacccgtgggaacgggtaccggaacgggtcccttacgaacctttatttaagtttcggaacctagtaccttcaactttaaacaccgaaaaggccgtaggtacgtacccgttaaggtttcgggggttacgtttaccggggacgggtaaccggggacccgttaaccgttcgggaccttcggtttacggacaccggtaccgaacggtccgtcccgccccgttcgtacncttccgtccgttccccgccctcctcgtactactaccacgtaccgtggtacggtcggaccgtcggacgtaacgccgacgagtcagcacgtacnggctagacgcgtcgatgngncnctatcgcagcgtacncgtnagntcgtanc

SEQ ID NO: 177054 - DNA, 558 bp, Homo sapiens
  misc_feature: GYAE6OF02H69PD.37.78.H01.1.454.CMB.1.raw
  modified_base (188)..(188): a, c, t, g, unknown or other
  misc_feature (188)..(188): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (449)..(449): a, c, t, g, unknown or other
  misc_feature (449)..(449): n is a, c, g, or t
  modified_base (511)..(511): a, c, t, g, unknown or other
  misc_feature (511)..(511): n is a, c, g, or t
  modified_base (516)..(517): a, c, t, g, unknown or other
  misc_feature (516)..(517): n is a, c, g, or t
  modified_base (519)..(521): a, c, t, g, unknown or other
  misc_feature (519)..(521): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
tcagtagtgtagatcacgaccggtgctcgatttagtgtgagtagtttggggtttgggggcttttgtctgggtctcctggacagtcgatcaccatctcctgcactggaaccagcagtgatattgaaacttataaccttgtctcttggtaccaacagcacccaggcaaacgcccccaaatcatgatttgngaggacagtaagcggcctcgaggggtttcaatcgcttctctggctccgaaagtctaggcaaacacggccttccctagactaatctcngggctccgaggctgacggacgaggctgaactttatacngctgctacatagtgcaggtagtcacttctatgtcgttacggaaactggggaacctaacggtcaaccgtacttaaagcacgaccctaaacggcccaaaccccatcgtacactccgtacgttcccccgtccttacccnctaacttacctaactactaccgtaggacgacgggcgttcggacaaggaccgacaagtacggntcgannannncgagcacgnacgcancacacnanacganancacagac

SEQ ID NO: 177055 - DNA, 729 bp, Homo sapiens
  misc_feature: GYAE6OF02GQXFN.37.78.H01.1.454.CMB.1.raw
  modified_base (661)..(661): a, c, t, g, unknown or other
  misc_feature (661)..(661): n is a, c, g, or t
  modified_base (666)..(666): a, c, t, g, unknown or other
  misc_feature (666)..(666): n is a, c, g, or t
  modified_base (679)..(679): a, c, t, g, unknown or other
  misc_feature (679)..(679): n is a, c, g, or t
tcagtagtgtagatcacgaccggtgctcgatttagtgtgagtagtttgggtttgggggcgtttgtctgggtctcctggacagtcgatcaccatccccctgcactcggaacctagtagtgacgttgatgattatgactaatcgttctcctggtttacaacaaacctacccaagtaacaaaacgacccccctaaaacgtcatactatttttagaggtcaactaatcggccctcgaggtaatttcttctcgcttctcgtcgtcctaccaagtctcggaccaacgaccggtcctccttcgaccatcctacgtggtcctccgagaccgtaggaacggacgcggtacgtctagttactttacgtgacgtagttacagtaacgtacggacgggtaccgtaacctaacgtacgttacgtcgttccgttacgggtaacggtacgggtaaccgtaacggggtcgttaccggttaccgttaaacggtccgtaaccgacccgtaaaccgacccctaaacccccgtactaccggtacccgtaccgtccgttacccgtaccccgtcccccgttacctaccgtacttaaccccgtaacgtaccttaacgtacggaacggtcgggtaccgtacggtaccgaaacggtaccgcgtaaagtcggtcagtccgatacgtnacgtntacgtcgattagntactccggatggtctaagcccgttaatcggagtacgtagtactgtgtacg

SEQ ID NO: 177056 - DNA, 682 bp, Homo sapiens
  misc_feature: GYAE6OF02F9S10.37.78.H01.1.454.CMB.1.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (654)..(654): a, c, t, g, unknown or other
  misc_feature (654)..(654): n is a, c, g, or t
  modified_base (659)..(659): a, c, t, g, unknown or other
  misc_feature (659)..(659): n is a, c, g, or t
  modified_base (679)..(679): a, c, t, g, unknown or other
  misc_feature (679)..(679): n is a, c, g, or t
tcagtagtgtagatcacgaccggtgctcgatttagtgtgagtagtttgggtttgggggctttggtctgggtctcctggacagtcgatcacccagtcccctgcactggaaccagtagtgacgttgatgattatgactatgtctcctggtttcaacaacaccctagacaaagtccccaaactcatcattttgaggtcactaatcggccctcaggaatttctctacgcttctctgcctctaacgcttggcaacacggctcttnaccatctctgggctccganacgtgaaggcaggtntgattattaactgccaggtttacattaagtaggacgggccgtaccaacctacgtttaactcggtactttccgggaaaaggttcggggaacccaaggggttcctacggttacccttaaaaggtcgaacggtccccaaagggaccccaaacccccgtataggttcccaacccgtttaccgttaccggtttaccccgtaaccccgttacccgtccctaacgtaccttaaccgtaccttaaccgtacggttacggaccggggttaccttcgggaccgttaaacgggccgtacgtaactaacggtagtacttacgactcgtaacggtccaagttacccgagttacgactagcgactacacgttangtacncgactactcgtacgtctctntac

SEQ ID NO: 177057 - DNA, 560 bp, Homo sapiens
  misc_feature: GYAE6OF02JCAM0.37.78.H01.1.454.CMB.1.raw
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
  modified_base (487)..(487): a, c, t, g, unknown or other
  misc_feature (487)..(487): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (539)..(560): a, c, t, g, unknown or other
  misc_feature (539)..(560): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttcaacaacacccagacaaacgcccccaaaactcatctatttttgaggtcactaatcggccctcaggtaactttcttctcgtccttctctgcctccaagtctggcaacgaccggcctccttcgaccntctcgtgggcnccagacctggaggacgaggctagtatttattactnactgttcatagtagagaccgaccactacttatcgtcttacggaaggtggaccgtaacggtcgtccgtaccgttaagtccaacgacccgaacgcccaaacccgnttcgacctacttccgtttccgttccccccgcccttccgtactacgttaccctaccgaccttaccgnggaacggtccggttacgtcggacgacgccgtacgagtagcntngnngtactnnnnnnnnnnnnnnnnnnnnnn

SEQ ID NO: 177058 - DNA, 700 bp, Homo sapiens
  misc_feature: GYAE6OF02GJ6NJ.37.78.H01.1.454.CMB.1.raw
  modified_base (161)..(161): a, c, t, g, unknown or other
  misc_feature (161)..(161): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
  modified_base (686)..(686): a, c, t, g, unknown or other
  misc_feature (686)..(686): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctcctggtttacaacaacacccanacaaacgccccaaactcatctattttgagtcactaatcggccctcgaggtaactttcttactcgcttctctcgccctctaagtctgcaacacggtcctctcgactactcgtacgtcgggtcctaccgaacgtacgtacggtaacggaaccggtaggtccgttaggtaacttttaacgtttaaccgtcgtaccgttaagtttaccgtaacgttaagttaacgggacggtaccgaaccctacgtaactttagtcgttaccggttacgggaagttcggggaacctagggttccgttcgtacctaagtccgaacgtaccccgaacggacccctaaaccccgtagtacgtacctaaccgtttccgttacccgttaccccctacccgtttaccctccgtaacttcccgtaacccgtaacttcggttacggacgggtccgggttcgtacgggaacgtacgggccgtctaagttacgctgtacgctcggtcaacgggtcagtcgacgtgacgtcactcggnactcncgagcgngtatctcgactgac

SEQ ID NO: 177059 - DNA, 752 bp, Homo sapiens
  misc_feature: GYAE6OF02I29FC.37.78.H01.1.454.CMB.1.raw
  modified_base (290)..(290): a, c, t, g, unknown or other
  misc_feature (290)..(290): n is a, c, g, or t
  modified_base (706)..(706): a, c, t, g, unknown or other
  misc_feature (706)..(706): n is a, c, g, or t
  modified_base (713)..(715): a, c, t, g, unknown or other
  misc_feature (713)..(715): n is a, c, g, or t
  modified_base (721)..(722): a, c, t, g, unknown or other
  misc_feature (721)..(722): n is a, c, g, or t
  modified_base (724)..(724): a, c, t, g, unknown or other
  misc_feature (724)..(724): n is a, c, g, or t
  modified_base (726)..(726): a, c, t, g, unknown or other
  misc_feature (726)..(726): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
  modified_base (733)..(733): a, c, t, g, unknown or other
  misc_feature (733)..(733): n is a, c, g, or t
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
  modified_base (742)..(742): a, c, t, g, unknown or other
  misc_feature (742)..(742): n is a, c, g, or t
  modified_base (745)..(745): a, c, t, g, unknown or other
  misc_feature (745)..(745): n is a, c, g, or t
  modified_base (747)..(747): a, c, t, g, unknown or other
  misc_feature (747)..(747): n is a, c, g, or t
  modified_base (749)..(751): a, c, t, g, unknown or other
  misc_feature (749)..(751): n is a, c, g, or t
tcagtagtgtagatcacgaccggtgctcgatttagtgtgagtagtttgggtttgggggctttgtctgggtctcctggacagtcgatcaccatcccctgcactggaaccagtagtgacgttgatgattatgactatgtctccttggtttacaacaacacccagaacaaacgcccccaaactcatctatttttgaggtcactaagtccggccctcgaggtaatttctttctcgtctttctcgtcgccctactaagttctcggacaaccgaccggtcccttccttcgaccctnttccgtcgttacgggcctaccgacgtacgtagggaacggggacggtacgggtcgttagtattttaacgttacgttcggacgttacggtttacaattacggttaaggacggacccggaaccctaaccttaagttttacgtacggtttacggttaaccgggggtaacggttaccgggggaaaccgttaacggggttcccggtttaccggtaaccctttaaacggtccccggaaaccggtaccccgaaaccgggtaccccccaaacccccttacggttcccgtacccgtaaccgtttcccggttaccccgtttcccccgtacccctttaccgtaccctacttacccgtaacctaccgtaccggtaggaccgggtcggggtccgtacgggcggaaccggtccgtaacgtacgtaacgtcngtacgcnnncgctgnngncngcncncnctncnctcngcncncnnnc

SEQ ID NO: 177060 - DNA, 654 bp, Homo sapiens
  misc_feature: GYAE6OF02IAYPX.37.78.H01.1.454.CMB.1.raw
  modified_base (123)..(123): a, c, t, g, unknown or other
  misc_feature (123)..(123): n is a, c, g, or t
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (627)..(628): a, c, t, g, unknown or other
  misc_feature (627)..(628): n is a, c, g, or t
  modified_base (630)..(632): a, c, t, g, unknown or other
  misc_feature (630)..(632): n is a, c, g, or t
  modified_base (634)..(654): a, c, t, g, unknown or other
  misc_feature (634)..(654): n is a, c, g, or t
tcagtagtgtagatcacgaccggtgctcgatttagtgtgagtagtttggggtttgggggctttgtctgggtctcctggacagtcgatcaccatcccctgcactggaaccagtagtgacgttgntagattatgactatgtctccttgttacaacaacaccanaacaaccaccccaatcatnttattttgagtcatanccgcctnagttatttctcnctcttctctcgcctacctagtctggacaacgccgtccttcctanacctagtccgtcgcggtctaccaggtacgtaggaacggcgtacggtacctagttaactttacgttacgtcgacgttaacgtttacgaattaggtaacgggaccgacccgtaacctaacttacgtttagttccgttacggttacggggtacggtaacgggacgttaccggttcgtaacccgttacgtaaacgtccgaccgaacccgtaaccgtacccccgaaacccgttccgtactccttacccgttacccgttccccgttacccccctacccgttacctaacccgttacttacccgttaaccctaagtcccggttacggaccgggttccggacggtttaccgccgggaacgtccggactacgtgctanntnnncnnnnnnnnnnnnnnnnnnnnn

SEQ ID NO: 177061 - DNA, 627 bp, Homo sapiens
  misc_feature: GYAE6OF02GT2UN.37.78.H01.1.454.CMB.1.raw
  modified_base (225)..(225): a, c, t, g, unknown or other
  misc_feature (225)..(225): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
  modified_base (476)..(476): a, c, t, g, unknown or other
  misc_feature (476)..(476): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
  modified_base (590)..(590): a, c, t, g, unknown or other
  misc_feature (590)..(590): n is a, c, g, or t
  modified_base (607)..(607): a, c, t, g, unknown or other
  misc_feature (607)..(607): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
tcagtagtgtagatcacgaccggtgctcgatttagtgtgagtagtttgggtttgggggtctttgtctgggtctcctggacagtcgatcaccatccctgcactggaaccagtagtgacgttgatgattatgactatgtctctggttacaacaacaccagacaacgccccaaatcatctattttgaggtcaatagtccgcctagagtaactttctactcgtctttcncgtcgcctaccgtaagtctggaaccaacgaccggtacccttcttacgacctacttccgtcggtacggcctacgacgtacgtggaacggacgngtcgttagtattaattcgagctagtactaanagtagacggacgtaacacgttattagttcggtatacgggtacgaggacgtacgtcgtactacgtatcgacgtcaacggacccaaccgtgtcgtactccgttcttaccgttacccctcgttaccttaancctttaccgtaaacttaccggtacgacgggtacgggtacggttacgaccggtaaccgaaggttcgaacctttaaggcacgatgaacgtntcagtcgngagtcntacacgtacgntactcgtacgtacgtanactacgacnctactanagcg

SEQ ID NO: 177062 - DNA, 163 bp, Homo sapiens
  misc_feature: GYAE6OF01CYE8H.16.57.F02.1.454.CMB.1.raw
  modified_base (163)..(163): a, c, t, g, unknown or other
  misc_feature (163)..(163): n is a, c, g, or t
tcagtgtactactccacgaccggtgctcgatttagctcgatatagttgggtttgggcggagggaccaagctgaccgtcctaagtcagcccaaggctgcccctcggtcattctgttcccaccctcctcgagtagtacactgagcgggctggcaaggcgcatagn

SEQ ID NO: 177063 - DNA, 164 bp, Homo sapiens
  misc_feature: GYAE6OF01CV1PP.16.57.F02.1.454.CMB.1.raw
  modified_base (164)..(164): a, c, t, g, unknown or other
  misc_feature (164)..(164): n is a, c, g, or t
tcagtgtactactccacgaccggtgctcgatttagctcgatatagttgggtttggggcggagggaccaagctgaccgtcctaagtcagcccaaggctgcccctcggtcactctgttcccgccctcctcgagtagtacactgagcgggctggcaaggcgcatagn

SEQ ID NO: 177064 - DNA, 171 bp, Homo sapiens
  misc_feature: GYAE6OF01AGRH5.16.57.F02.1.454.CMB.1.raw
  modified_base (166)..(171): a, c, t, g, unknown or other
  misc_feature (166)..(171): n is a, c, g, or t
tcagtgtactactccacgaccggtgctcgatttagctcgatatagttgggtttggggcggagggaccaaggctgaccgtcctaagtcagcccaaggctgccccctcggtcactctgttcccaccctcctcgagtagtacactgagcgggctggcaaggcgcatagnnnnnn

SEQ ID NO: 177065 - DNA, 209 bp, Homo sapiens
  misc_feature: GYAE6OF01C0X7L.16.57.F02.1.454.CMB.1.raw
  modified_base (207)..(209): a, c, t, g, unknown or other
  misc_feature (207)..(209): n is a, c, g, or t
tcagtgtactactccacgaccggtgctcgatttagctcgatatagttgggtttggggatcaccgtctcctcagcctccaccaagggcccatcggtcttcccctggcaccctcctccaagagcacctctgggggcacagcggccctgggctgcctggtcaaggactacttccgagtagtacactgagcgggctggcaaggcgcatagnnn

SEQ ID NO: 177066 - DNA, 167 bp, Homo sapiens
  misc_feature: GYAE6OF01DZZ18.16.57.F02.1.454.CMB.1.raw
  modified_base (161)..(167): a, c, t, g, unknown or other
  misc_feature (161)..(167): n is a, c, g, or t
tcagtgtactactccacgaccggtgctcgatttagctcgatatagttgggtttggggcggagggaccaagctgaccgtcctaagtcagcccaaggctgcccctggtcactctgttcccacctctcgagtagtacactgagcgggctggcaaggcgcatagnnnnnnn

SEQ ID NO: 177067 - DNA, 165 bp, Homo sapiens
  misc_feature: GYAE6OF01AXGE3.16.57.F02.1.454.CMB.1.raw
  modified_base (165)..(165): a, c, t, g, unknown or other
  misc_feature (165)..(165): n is a, c, g, or t
tcagtgtactactccacgaccggtgctcgatttagctcgatatagttgggtttggggcggagggaccaagctgaccgtcctaagtcagcccaaggctgccccctcggtcactctgttcccaccctcctcgagtagtacactgagcgggctggcaaggcgcatagn

SEQ ID NO: 177068 - DNA, 207 bp, Homo sapiens
  misc_feature: GYAE6OF01C81BC.16.57.F02.1.454.CMB.1.raw
  modified_base (207)..(207): a, c, t, g, unknown or other
  misc_feature (207)..(207): n is a, c, g, or t
tcagtgtactactccacgaccggtgctcgatttagctcgatatagttgggtttggggatcaccgtctcctcagcctccaccaagggcccatcggtcttcccctggcaccctcctccaagagcacctctgggggcacagcggccctgggctgcctggtcaaggactacttccgagtagtacactgagcgggctggcaaggcgcatagn

SEQ ID NO: 177069 - DNA, 211 bp, Homo sapiens
  misc_feature: GYAE6OF01BMYQS.16.57.F02.1.454.CMB.1.raw
  modified_base (208)..(211): a, c, t, g, unknown or other
  misc_feature (208)..(211): n is a, c, g, or t
tcagtgtactactccacgaccggtgctcgatttagctcgatatagttgggtttggggatcaccgtctcctcagcctccaccaagggcccatcggtcttccccctggcaccctcctccaagagcacctctgggggcacagcggccccggcgtgcctggtcaggactacttccgagtagtacactgagcgggcgtggcaaggcgcatagnnnn

SEQ ID NO: 177070 - DNA, 210 bp, Homo sapiens
  misc_feature: GYAE6OF01BAEOO.16.57.F02.1.454.CMB.1.raw
  modified_base (208)..(210): a, c, t, g, unknown or other
  misc_feature (208)..(210): n is a, c, g, or t
tcagtgtactactccacgaccggtgctcgatttagctcgatatagttgggtttggggatcaccgtctcctcagcctccaccaagggcccatcggtcttccccctggcaccctcctccaagagcacctctgggggcacagcggccctgggctgcctggtcaaggactacttccgagtagtacactgagcgggctggcaaggcgcatagnnn

SEQ ID NO: 177071 - DNA, 764 bp, Homo sapiens
  misc_feature: GYAE6OF01E3LJO.16.57.F02.1.454.CMB.1.raw
  modified_base (222)..(222): a, c, t, g, unknown or other
  misc_feature (222)..(222): n is a, c, g, or t
tcagtgtactactccacgaccggtgctcgatttagctcgatatagttggggtttgggggggggtctcaggaggcagcgctctcaggacatctccaccatggcctgggctctgctgctcctcaccctcctcactcagggcacagggtcctgggcccagtctgccctgactcagcctgcctccgtgtctggacttctcgtggacagtcgatcatctattcttcngccacgtggtactccgagacgtaggttgtacggtttggtagtaatttaattaactttcgtccttccgtacggtaacctaaacaacccgaccgaacggaaccaaacccgacccccaaaactccaacttactatttacgtagtaacgttcttacgtaaggtcccggtacctaggaacgggttacttacgtaacgttccgttacttccgtcgtacggtccttaccgtaagttccgtacggaaccctaaccggacccgttccccgttccgttaccggacccgttccgtaccgtccggtacccttaccgaacgtaccgtaggaacggtacggacgtcgttagtaacttttacgtaccgtcgtaacctacgtactaagtaacgtaagtaacgttaacttaccttaccgttccgggtttggtttcgggtttaccgggaacggggtaaccgtaaccgtacggttaccgtacccggttacccgtaccgttacggacccgtaaccgggtaccgtaaacccgggtcccgtcccccggtccccgtttacccggg

SEQ ID NO: 177072 - DNA, 174 bp, Homo sapiens
  misc_feature: GYAE6OF01B48NP.16.57.F02.1.454.CMB.1.raw
  modified_base (168)..(174): a, c, t, g, unknown or other
  misc_feature (168)..(174): n is a, c, g, or t
tcagtgtactactccacgaccggtgctcgatttagctcgatatagttgggtttgggggcggagggaccaagctgaccgtcctaagtcagcccaaggctgccccctcggtcactctcgttccccaccctcctcgagtagtacactgagcgggctggcaaggcgcatagnnnnnnn

SEQ ID NO: 177073 - DNA, 164 bp, Homo sapiens
  misc_feature: GYAE6OF02HUTRZ.16.57.F02.1.454.CMB.1.raw
  modified_base (163)..(164): a, c, t, g, unknown or other
  misc_feature (163)..(164): n is a, c, g, or t
tcagtgtactactccacgaccggtgctcgatttagctcgatatagttgggtttgggcggagggaccaagctgaccgtcctaagtcagcccaaggctgcccctcggtcactctgttcccaccctcctcgagtagtacactgagcgggctggcaaggcgcatagnn

SEQ ID NO: 177074 - DNA, 164 bp, Homo sapiens
  misc_feature: GYAE6OF02JHWWB.16.57.F02.1.454.CMB.1.raw
  modified_base (164)..(164): a, c, t, g, unknown or other
  misc_feature (164)..(164): n is a, c, g, or t
tcagtgtactactccacgaccggtgctcgatttagctcgatatagttgggtttggggcggagggaccaagctgaccgtcctaagtcagcccaaggctgcccctcggtcactctgttcccaccctcctcgagtagtacactgagcgggctggcaaggcgcatagn

SEQ ID NO: 177075 - DNA, 208 bp, Homo sapiens
  misc_feature: GYAE6OF02GBMN7.16.57.F02.1.454.CMB.1.raw
  modified_base (207)..(208): a, c, t, g, unknown or other
  misc_feature (207)..(208): n is a, c, g, or t
tcagtgtactactccacgaccggtgctcgatttagctcgatatagttgggtttggggatcaccgtctcctcagcctccaccaagggcccatcggtcttcccctggcaccctcctccaagagcacctctgggggcacagcggccctgggctgcctggtcaaggactacttccgagtagtacactgagcgggctggcaaggcgcatagnn

SEQ ID NO: 177076 - DNA, 165 bp, Homo sapiens
  misc_feature: GYAE6OF02HXG3T.16.57.F02.1.454.CMB.1.raw
  modified_base (165)..(165): a, c, t, g, unknown or other
  misc_feature (165)..(165): n is a, c, g, or t
tcagtgtactactccacgaccggtgctcgatttagctcgatatagttgggtttggggcggagggaccaagctgaccgtcctaagtcagcccaaggctgccccctcggtcactctgttcccgccctcctcgagtagtacactgagcgggctggcaaggcgcatagn

SEQ ID NO: 177077 - DNA, 207 bp, Homo sapiens
  misc_feature: GYAE6OF02IG4J5.16.57.F02.1.454.CMB.1.raw
  modified_base (207)..(207): a, c, t, g, unknown or other
  misc_feature (207)..(207): n is a, c, g, or t
tcagtgtactactccacgaccggtgctcgatttagctcgatatagttgggtttggggatcaccgtctcctcagcctccaccaagggcccatcggtcttccccctggcaccctcctccaagagcacctctggggcacagcggccctgggctgcctggtcaaggactacttccgagtagtacactgagcgggctggcaaggcgcatagn

SEQ ID NO: 177078 - DNA, 171 bp, Homo sapiens
  misc_feature: GYAE6OF01CBKDQ.14.86.H09.1.454.CMB.1.raw
  modified_base (170)..(171): a, c, t, g, unknown or other
  misc_feature (170)..(171): n is a, c, g, or t
tcagcgtctagtaccacgaccggtgctcgatttagtgctatagacttgggtttgggaagaggaagactgacggtccccaggagttcaggtgctgggcacagcggccctgggctgcctggtcaaggactacttccgtactagacgctgagcgggctggcaaggcgcatagnn

SEQ ID NO: 177079 - DNA, 173 bp, Homo sapiens
  misc_feature: GYAE6OF01ES9U0.14.86.H09.1.454.CMB.1.raw
  modified_base (173)..(173): a, c, t, g, unknown or other
  misc_feature (173)..(173): n is a, c, g, or t
tcagcgtctagtaccacgaccggtgctcgatttagtgctatagacttgggtttgggggaagaggaagactgacggtcccccaggagttcaggtgctgggcacagcggccctgggctgcctggtcaaggactacttccgtactagacgctgagcgggctggcaaggcgcatagn

SEQ ID NO: 177080 - DNA, 527 bp, Homo sapiens
  misc_feature: GYAE6OF01COI3K.14.86.H09.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (519)..(519): a, c, t, g, unknown or other
  misc_feature (519)..(519): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccagccaccctgtctttgtctccaggggaaanagccaccctctcctgcagggccagtcagagtgttagcacctccttagcctggtaccaanagaaacctggccaggcctcccagcctcctcatctctgatgcttccaacagggccacgtggcatcccagccaggttcagtggcaggtgggtctgggacagacttcactctcacctatcagcctccctagacgcctggagtattttgtagtttattactgtcagtctagtatagcagtctcggcccttcccgtacgtttcggcggacgggaccgagggtggagactccgaacgacgtggtggctgacacatctgtcttcntcctcccg

SEQ ID NO: 177081 - DNA, 550 bp, Homo sapiens
  misc_feature: GYAE6OF01BLN6X.14.86.H09.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagngccaccctntcctgcagggccagtcagagtgttagccacctccttagcctggtaccaacagaaacctggccaggctcccagcctcctcatctctgatgcttccaacagggcccactggcatcccagccaggttcagtggcaggtgggtctgggacagacttcactctcaccatcagcctccctagacgcctggagtattttgtagtttattactgtcagcagtatagcagctcggcctcccgacgtttcgggcggagggaccgaagggtcggagtactccgaaacggtaacgtggtagggctcggacctacccgattccgtggttaccttctcttcccttcccccg

SEQ ID NO: 177082 - DNA, 500 bp, Homo sapiens
  misc_feature: GYAE6OF01DQ34N.14.86.H09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccacctctcctgcagggccagtcagagtgttagcacctccttagcctggtaccaanagaaacctggccaggctcccagcctcctcatctctgatgcttccaacaggccactggcatcccagccaggttcagtggcagtgggtctgggacagacttcactctcaccatcagctccctagagcctggagattttgctagtttattactgtcagcagcgtaccaactggcctctgcgctcactttcggcggagggaccaaggtggagatcaaagaactgtggctgcacatctgtcttac

SEQ ID NO: 177083 - DNA, 511 bp, Homo sapiens
  misc_feature: GYAE6OF01BIR22.14.86.H09.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (504)..(504): a, c, t, g, unknown or other
  misc_feature (504)..(504): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaacagaaacctggccaggctcccagcctcctcatctctgatgcttccaacngggccactggcatcccagccaggttcagtggcagtgggtctgggacagacttcactctcaccatcagctccctagagcctggagtattttgtagtttattactgtcagctagtatagcagctggcctcccgacgtttcggcggtacgggaccaagggtggagactccgaagactggtggctgcacatctgtctcntctcccg

SEQ ID NO: 177084 - DNA, 194 bp, Homo sapiens
  misc_feature: GYAE6OF01A44AZ.14.86.H09.1.454.CMB.1.raw
  modified_base (174)..(194): a, c, t, g, unknown or other
  misc_feature (174)..(194): n is a, c, g, or t
tcagcgtctagtaccacgaccggtgctcgatttagtgctatagacttgggtttgggggaagaggaagactgacggtcccccaggagttcaggtgctgggcacacgcggccctgggctgcctggtcaaggctacttccgtactagacgctgagcgggctgggcaaggcgcatagnnnnnnnnnnnnnnnnnnnnn

SEQ ID NO: 177085 - DNA, 515 bp, Homo sapiens
  misc_feature: GYAE6OF01EF4GA.14.86.H09.1.454.CMB.1.raw
  modified_base (203)..(203): a, c, t, g, unknown or other
  misc_feature (203)..(203): n is a, c, g, or t
  modified_base (503)..(503): a, c, t, g, unknown or other
  misc_feature (503)..(503): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccacctctcctgcagggccagtcagagtgttagcacctccttagcctggtaccaacagaaacctggccaggctcccagcctctcatctctgatgcttccaacagggccactggcatcccagccaggttcagtggcagtgggtctgggacagacttcactctcaccatcagctccctagagcctggagtattttgtagtttattactgtctagctagtatagcagctggcctcccacgtttcggcggagggaccaggtggagataccgaagaacgtgtggctcgcaccatctgtcttcnttccgttccccg

SEQ ID NO: 177086 - DNA, 174 bp, Homo sapiens
  misc_feature: GYAE6OF01D0KOD.14.86.H09.1.454.CMB.1.raw
  modified_base (173)..(174): a, c, t, g, unknown or other
  misc_feature (173)..(174): n is a, c, g, or t
tcagcgtctagtaccacgaccggtgctcgatttagtgctatagacttgggtttgggggaagaggaagactgacggtcccccaggagttcaggtgctgggcacagcggccctgggctgcctggtcaaggactacttccgtactagacgctgagcgggctggcaaggcgcatagnn

SEQ ID NO: 177087 - DNA, 189 bp, Homo sapiens
  misc_feature: GYAE6OF01DQOMC.14.86.H09.1.454.CMB.1.raw
  modified_base (70)..(70): a, c, t, g, unknown or other
  misc_feature (70)..(70): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (174)..(189): a, c, t, g, unknown or other
  misc_feature (174)..(189): n is a, c, g, or t
tcagcgtctagtaccacgaccggtgctcgatttagtgctatagacttgggtttgggggaagaggaagacngacggtcccccaggagttcaggtgctgggcacagcggccctggctgcctggtcaaggcctacttccgtactagacgctgagcgggctaggcaaggcgcntancnnnnnnnnnnnnnnnn

SEQ ID NO: 177088 - DNA, 549 bp, Homo sapiens
  misc_feature: GYAE6OF01DOI27.14.86.H09.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaanagaaacctggccaggctcccagcctcctcatctctgatgcttccaacagggccactggcatcccagccaggttcagtggcaggtgggtctgggacagacttcactctcaccatcagcctccctagacgcctggagtattttgtagttttatacttgtcagctagtatagcagctcggccttcccgtacgtttcggacgggtacgggaccgagggtcggaggtactaccgaacgtacgtcggtggctcgaccacctattccttagtcctttcacgttcccgttaccccg

SEQ ID NO: 177089 - DNA, 507 bp, Homo sapiens
  misc_feature: GYAE6OF01CP1RY.14.86.H09.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
  modified_base (498)..(498): a, c, t, g, unknown or other
  misc_feature (498)..(498): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctccttagcctggtaccaangaaacctggccaggctcccagcctcctcatctctgatgcttccaacaggccactggcatcccagccaggttcagtggcagtgggtctgggacngacttcactctcaccatcagctccctagagcctggatattttgtagtttattactgtcagcagtatagcagctggcctcccacgtttcggcggaggaccaggtggagatccgaagaacgtgtaggctgcaccatctgtcttcnttcctcccg

SEQ ID NO: 177090 - DNA, 702 bp, Homo sapiens
  misc_feature: GYAE6OF01D7TWK.14.86.H09.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (369)..(369): a, c, t, g, unknown or other
  misc_feature (369)..(369): n is a, c, g, or t
tcagcgtctagtaccacgaccggtgctcgattttagtgctatagactttggggtttgggggaaggaactcgctcgagttaggacccagagggaaccatggcagccccagctcagcttctcttcctcctgtctactctggctcccagatatcaccggagaaattgtgttgacacagtctccagccaccctgtctttgtctccgaggggaangccaccctctcctgcagggccagtcagagtnttagcacctcttagcctggtaccaacagaaacctggaccaggcctcccgagcctcctcatctctggatcgccttaccaacgagggccacgtggcactcccagcctaggttcaggtggcaggtgggtcngggacagtacttcacgtcctacaccatcaggtcctacccgtagacgtccgtggaacgttattttaggtacgtttttattaccgttgttccgtagtcgtaagtaacttacggacgtaacggtccgttccggggtacccccttaccccgttaaccggtttttacccgggggacggggttaaacgggtaaccccggtaaagggggttcggggtaaacgtaaccggttaccccggaaacggttaaaccggttcgggttacggggacctttcgggacccgtaaccgttacgttacccgtttggttacctttacccgtactttccccggttacccccgg

SEQ ID NO: 177091 - DNA, 603 bp, Homo sapiens
  misc_feature: GYAE6OF01BP1J6.14.86.H09.1.454.CMB.1.raw
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccccgtntttgtctccaggggaaangccaccctctcctgcagggccagtcagagtgttagcacctcttagcctggtaccaacagaaacctggccaggcctcccagcctcctcatctctgatgcttccaacagggccactggcactcccagccaggttcagtggcaggtgggtctggggacagacttcactctcaccatcagcctccctagcgcctggatattttgtaagtttattactgtacagtcagtatagcagctcggcccttcccgtacgtttcggggacgggtaacgggacccgaaggggtggaacgtacgttacccgaaaacggtaaccgttgggtacgggtccttacgggaccctaacccgtagtttcccgttacggttacccttttacccaacgttttccccgttacccccggtacc

SEQ ID NO: 177092 - DNA, 172 bp, Homo sapiens
  misc_feature: GYAE6OF01CZ7YM.14.86.H09.1.454.CMB.1.raw
  modified_base (172)..(172): a, c, t, g, unknown or other
  misc_feature (172)..(172): n is a, c, g, or t
tcagcgtctagtaccacgaccggtgctcgatttagtgctatagacttgggtttgggggaagaggaagactgacggtcccccaggagttcaggtgctgggcacagcggccctgggctgcctggtcaaggactacttccgtactagacgctgagcggctggcaaggcgcatagn

SEQ ID NO: 177093 - DNA, 582 bp, Homo sapiens
  misc_feature: GYAE6OF01DYBY4.14.86.H09.1.454.CMB.1.raw
  modified_base (308)..(308): a, c, t, g, unknown or other
  misc_feature (308)..(308): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggctcctcatgtatgatgcatcccanacgggccaccggcactcccagccaggttcagtcgcaggcgggtctgggacacgacttcgactcgtcaccatcagcacgcctagacgtctaggtaagtagttttgacttagttttattacgtgttacagacgtagggccgggactaagttcggccgtcgtaccgtacggtttcggggaccgggggtacgtaaggggtggtacgttaccgaaacgtacgtcggtaggactcgaccgtactacgttcgttcgttacttcgtacgttccgttaccccg

SEQ ID NO: 177094 - DNA, 689 bp, Homo sapiens
  misc_feature: GYAE6OF01BYL7M.14.86.H09.1.454.CMB.1.raw
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (552)..(552): a, c, t, g, unknown or other
  misc_feature (552)..(552): n is a, c, g, or t
  modified_base (647)..(647): a, c, t, g, unknown or other
  misc_feature (647)..(647): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctccgngcgacggcagtacgagtgttgtacacctaccttcgtacgccgtacgtaaccaacgaaccgtaaccgtcggaccgacggtccctacccgacgtcccttcctactacttccttcgtacgtacgtccgtcccttaaccgaacggccggacctacggtcggacctaccgtacccgacgtaccgttagtcgaggtcgacgtagggttcgggtacgtacgggactacgttaccttccacgttccaccgactactacgacgtccctacgaggaccgtccggtaggttacgttttagttttagtttaacgtttactgttacgacgtagtacgtagtactacgngtacgtcgtccgtacccttacccgttacgggttccgggaacgggtaaccgaacggtaggtacggacgtaccaaccggaacgtagtcggtcgtacncgaacctactacgttctacgttactctccgttcccgtacccg

SEQ ID NO: 177095 - DNA, 586 bp, Homo sapiens
  misc_feature: GYAE6OF01D1MAN.14.86.H09.1.454.CMB.1.raw
  modified_base (262)..(262): a, c, t, g, unknown or other
  misc_feature (262)..(262): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaanagaaacctggccaggctcccagcctcctcatctctgatgcttccaacagggccactggcactcccagccaggttcaggtggcaggtgggtctgggacagtacttcactctcaccatcagcctcctagacgccgtggagttattttgtagtttattacgtgtcagtctagtatagcagtctcggtcccttcccgtacgtttccgggcgggtacgggacccgtaagggtcggaacgacgttacccgaaacggtaacgtggtacgggtactcggaccaacccgtacttccgttacggttcctttacctacgttcccgttacccccgg

SEQ ID NO: 177096 - DNA, 666 bp, Homo sapiens
  misc_feature: GYAE6OF01B3ZLH.14.86.H09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (353)..(353): a, c, t, g, unknown or other
  misc_feature (353)..(353): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctcttagcctggtaccaanagaaacctggccaggctcccagcctcctcatctctgatgcttccaacgcgggccactggcatcccagcccaggttcaggtggcaggtgggtcngggacaggtacttcactctcacctatcacgtcctcccgtagacgtccgtaggtacgttagtttttacgtaaggtttttacttacgttgttaccgaagtcctaagttattaagccgaagtcctcgggtcccttccccgtagggtttcccgggacgggtaacgggaacccgtagggtcgggtaacgtaaccgttacccgaaaaccggtacgttcgggttacgggacccgttacgggtaccctaaacccgttacggtttccctttaccgggttttacccctttttcccgtcccccggttttacccccggtaccccg

SEQ ID NO: 177097 - DNA, 201 bp, Homo sapiens
  misc_feature: GYAE6OF01B97E5.14.86.H09.1.454.CMB.1.raw
  modified_base (173)..(201): a, c, t, g, unknown or other
  misc_feature (173)..(201): n is a, c, g, or t
tcagcgtctagtaccacgaccggtgctcgatttagtgctatagacttgggtttgggggaaggaggaagactgacggtcccccaggagttcagggtgctgggcacagcgccctgggctgcctggtcaaggactacttccgtactagacgctgagcgggctggcaagcgcatagnnnnnnnnnnnnnnnnnnnnnnnnnnnnn

SEQ ID NO: 177098 - DNA, 666 bp, Homo sapiens
  misc_feature: GYAE6OF01ET0A4.14.86.H09.1.454.CMB.1.raw
  modified_base (206)..(206): a, c, t, g, unknown or other
  misc_feature (206)..(206): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
tcagcgtctagtaccacgaccggtgctcgatttagtgctatagactttgggtttgggggaggaactgctcagttaggacccagagggaaccatggcagcccccagctcagcttctcttcctcctgctactctggctcccagatatcaccggagaaattgtgttgacacagtctccagccaccctgtctttgtctccagggggaaangccaccctctcctgcagggccagtcagagtgttagcacctctagcctggtaccaacagaaacctggccaggctcccagcccctcatcacttcatgctcctaacgagcgacacgcgcnccncgcncgtcgtgagcgcgtggtcgtcggacgtacgactactactactctaccacactacntacgtaccgtacgtacgtacgtacgttaggttagtttagtttagtttaagtttaacgttacgtcgtancgtacgtaacgtaacgtaacgtacgtacgtaccgtcccggtacccggttaccccgttacccggttaccgggttacccggggtaaccggggtaaccgggtaaccgggtaacgggtacggtaacggtaaccgtaaccggtaaaccggtaacggttacgggtccggtaccgtaccgtaccgtaccgtaccgtttccgtttaccgtttccgttaccg

SEQ ID NO: 177099 - DNA, 592 bp, Homo sapiens
  misc_feature: GYAE6OF01EMN5M.14.86.H09.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagcacctccttagcctggtaccaacagaaacctggccaggcctcccagccctcctcactctctgatcgccttccaacgngggcccactggcactcccagccaggttcaggtggcaggtgggtctgggacagacttcactctcaccatcagtcctcctagcgtcgtggtagttagttttgtagtttattactgtctagtctagtatacgcagtcgtcgtccttacccgtacgtttccgggacgggtacgggaaccgtaagggtcggacgtacgtacccgtaaacgtaccgtcggtacggcgtcggaccgtaccgtacttccgttcgttacctttaccgtcgttccccgttaccccg

SEQ ID NO: 177100 - DNA, 190 bp, Homo sapiens
  misc_feature: GYAE6OF01CTRST.14.86.H09.1.454.CMB.1.raw
  modified_base (174)..(190): a, c, t, g, unknown or other
  misc_feature (174)..(190): n is a, c, g, or t
tcagcgtctagtaccacgaccggtgctcgatttagtgctatagacttgggtttgggggaaggaggaagactgacggtcccccaggagttcaggtgctgggcacagcggccctgggctgcctggtcaaggactacttccgtactagacgctgagcgggctggcaaggcgcatagnnnnnnnnnnnnnnnnn

SEQ ID NO: 177101 - DNA, 544 bp, Homo sapiens
  misc_feature: GYAE6OF01BTG9M.14.86.H09.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctcttagcctggtaccaacagaaacctggccaggctcccagcctcctcatctctgatgcttccaacngggccactggcatcccagccaggttcagtggcaggtgggtctgggacagacttcactctcacatcagcctccctagacgcctggagtattttgtagtttattactgtctagctagtatagcagctcggccctccctacgtttcggcggtacgggaccgtagggtggagtacgtaccgaaacggtacgtggtcggcgtgacccacgtattctcgttacttctacttccgttccccg

SEQ ID NO: 177102 - DNA, 174 bp, Homo sapiens; identical to SEQ ID NO: 177086
  misc_feature: GYAE6OF01C4YW9.14.86.H09.1.454.CMB.1.raw
  modified_base (173)..(174): a, c, t, g, unknown or other
  misc_feature (173)..(174): n is a, c, g, or t

SEQ ID NO: 177103 - DNA, 725 bp, Homo sapiens
  misc_feature: GYAE6OF01BPNLP.14.86.H09.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctccagatatcaccggagaaattgtgttgacacagtctccagccacctgtcttgtctccaggggaaangccacctctccngcagggccagtcagagtgttacgctacctccttagcctggtaaccaacgacgaaacctggaccacggcctcccgagccttcctcactctctgtattcgccttaccgaacgtacgggccctacgtcgggaccacgtccccgagtaccccgtaaggtttccgaagggttcggggacgtaacggggttcgggggtaccgttacggggggaaccaacgggttaaccctttccgaaacccttcccgttaaccgaacccctaaacgttccgaacggttccccttaaccccggtaaggtaccggtcccgtaagggtaacgtttagtttttacggttaagttttacttaacgtcgtactagactaagttactagtcgtacgtcgtacggtcccttaccccgtagtttaccggggacggaacggtaccggaaggtcgggaacgtaccgtacgaaaccggtacgtcggtaggtccgtagaccgtaacctagttcctcggttacctcgtacttcccgtacccg

SEQ ID NO: 177104 - DNA, 564 bp, Homo sapiens
  misc_feature: GYAE6OF01EA1K4.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctccttagcctggtaccaacagaaacctggccaggctctcagcctcctcatctctgatgcttccaacagggccactggcatcccagccaggttcagtggcagtgggtctgggacagacttcactctcacctatcagcctaccctagacgtccctagggagtatttttacggtagttttaattacttgtcagtcaagttatacgcaggcttgggccccttcccgtacgtttccgggacggtaggggaccctaaggggtcggaacgatacccgaacgaaacttgggttggccttgccaacctagtcttgtctttcagtttcccg

SEQ ID NO: 177105 - DNA, 579 bp, Homo sapiens
  misc_feature: GYAE6OF01DEIRE.14.86.H09.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagcacctccttagcctggtaccaanagaacctggccaggcctcccagcctcctcatctctgatgccttaccaacgagggcccactggcatcccagccaggttcagtggctaggtgggtctgggacagcttcactctcacatcagtcctccgtagacgtcctggagtattttgtagtttattactgtcagtcagttatagcagtcgtcggcccttcccgtacgtttccgggacgggtaacgggaccgtaagggtcggaacgtacgtacccgaaacgaacgttggtacggtcgtcgacctaccgtacgttccgttacgttaccttctacgttcccgttaccccg

SEQ ID NO: 177106 - DNA, 517 bp, Homo sapiens
  misc_feature: GYAE6OF01E2HEF.14.86.H09.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (509)..(509): a, c, t, g, unknown or other
  misc_feature (509)..(509): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccagggggaaanagccaccctctcctgcagggccagtcagagtgttagcacctccttagcctggtaccaacagaaacctggccaggctcccagcctcctcatctctgatgcttccaacngggccactggcatcccagccaggttcagtggcagtgggtctgggacagcttcactctcaccatcagctccctagacgcctggagtattttgtagttttattactgtcagcagtatagcagctggcctcccgacgtttcggcggtagggaccaggtggagacgtccaacgacgtggtggctcgcaccatctgttctctntcctcccg

SEQ ID NO: 177107 - DNA, 565 bp, Homo sapiens
  misc_feature: GYAE6OF01E2X51.14.86.H09.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagcccaccctgtctttgctccaggggaaangccaccctctcctgcagggccagtcagagtgttagcaccttccttagcctggtaccaanagaaacctggccaggcctcccagcctcctcatctctgatgcttccaacgngggccactggcatcccagccaggttcagtggcagtgggtctgggacaggcttcacgttctaccaccgatcgagtcctcccgtagacgccgtaggacgttnttttagttacgtttattactgttcagtctagtataagcagctgggccctcccgtacgtttccgggacggtacgggacctaagggtacgacggtactaccgaacgtacgtcggtggactgaccgactactctcgtacttcacttccgttacccg

SEQ ID NO: 177108 - DNA, 573 bp, Homo sapiens
  misc_feature: GYAE6OF01C1Q0Q.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctcttagcctggtaccaacagaaacctggccaggctcccagcctcctcatctctgatgcttccaacacgggccacgtggcactcccagccaggttcagtggcaggtgggtctgggacagacttcactctcaccatcagcctccctagcgcctggagtattttgtagttttattacgtgtacagtctagtatagcagtctcggccctccgtacgtttcgggacggacgggaccgtaggggtggacgacgtacccgaacggtaacgtcggtggccgttcggaccctaaccgtacttccgttcgttacctttcctaccttccccgttacccccg

SEQ ID NO: 177109 - DNA, 560 bp, Homo sapiens
  misc_feature: GYAE6OF01ALP5U.14.86.H09.1.454.CMB.1.raw
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgactgccttccaacagggccactggcatcccagccaggttcagtggcaggtgggtctgggacagcttcgactctcacntcagcctcctagagcctggagtatttgtagtttattactgtcaggtcagtatancgagctcggccttcccgacgttttccgggacggtagggacccgtaaggtcgggaagactaccgaaacgaacgtcggtaggccgtagacctaaccgtcgtacgttcgttaccttcctattcccgttaccccg

SEQ ID NO: 177110 - DNA, 619 bp, Homo sapiens
  misc_feature: GYAE6OF01AOQI2.14.86.H09.1.454.CMB.1.raw
  modified_base (203)..(203): a, c, t, g, unknown or other
  misc_feature (203)..(203): n is a, c, g, or t
  modified_base (585)..(585): a, c, t, g, unknown or other
  misc_feature (585)..(585): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaagngccaccctctcctgcagggccagtcagagtgtagcacctcttagcctggtaccaacagaacctggccaggcctcccagccctcctcactcctctgactcgccttaccaacgacgggcccacgtcggaccactcccagccgtaggttcaggtcgggctagggttcggggtcgtaggggacacggtacctttcgaccttcctaccaacctagtccgacgtccggttcctaccctaaccgtgtaacgttattttacgactaacttacctactacgtaccaacagtacgttatacgtactacccggtggtaccggttacggaccggaacggggtaccgtaagggtcggaagtacgtacgaaacgtacgtggtcggcgtcgacactntcgtcgttcttactacttcccttcccgctcgtcg

SEQ ID NO: 177111 - DNA, 550 bp, Homo sapiens
  misc_feature: GYAE6OF01A4A05.14.86.H09.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
  modified_base (434)..(434): a, c, t, g, unknown or other
  misc_feature (434)..(434): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccagggggaaanagccaccctctcctgcagggccagtcagagtgttagcacctccttagcctggtaccaacagaaacctggccaggctcccagcctcctcatctctgatgcttccaacacgggccactggcatcccagccaggttcagtggcaggtgggtctgggacagacttcactctcaccatcagcctccctagacnccgtggagtagttttgtagtttacttacgtgtctagcagtanagcagtctcggccctcccgtacgtttccgggacggtacgggaccaagggtggacgactacccgaacgtaaccgtggtggctgaccaccatctgtaccttctacgttccttaccccg

SEQ ID NO: 177112 - DNA, 790 bp, Homo sapiens
  misc_feature: GYAE6OF01CCSK1.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccagccaccctgtctttgtctccgaggggaagacgccacctctctgcgagggccagtcagagtgttagctacctccttagcctggtaaccaacaacgaaacctggccaggcctcccacgtccctcctcactctctgatcgtccttccgaacgcgggccacgtcggcactcccgagtcctagggtttcaggtcggcgtaggtcggggtcgtagggacacggtacttccacttcctacaacctatccacgtcccttacccgtaggaccgtccgttagggtaacgtttagttttttaggtttaacgtttttaacgtttaccgttaggttaccgtaaacggttaccgttaaaggtttaacgtaacgggtaccgttaaccgggtccggttacccgggttacccccctttaaccccgggttacccgggttttacccggggggaaccgggggttaaaccggggtaacccgggtaaagggggtaccgggtaaacggttaaccgtaaccccggtaaaacgggtaacggttggggttaccgggaccgttccggaaccccgtaaacccgttacggtttacccgtttacggtttacccttttacccgttaccgtttccccccgttaccccgg

SEQ ID NO: 177113 - DNA, 175 bp, Homo sapiens
  misc_feature: GYAE6OF01AO6Y8.14.86.H09.1.454.CMB.1.raw
  modified_base (173)..(175): a, c, t, g, unknown or other
  misc_feature (173)..(175): n is a, c, g, or t
tcagcgtctagtaccacgaccggtgctcgatttagtgctatagacttgggtttgggggaagaggaagactgacggtcccccaggagttcaggtgctgggcacagcggccctgggctgcctggtcaaggactacttccgtactagacgctgagcgggctggcaaggcgcatagnnn

SEQ ID NO: 177114 - DNA, 681 bp, Homo sapiens
  misc_feature: GYAE6OF01ENL3L.14.86.H09.1.454.CMB.1.raw
  modified_base (204)..(204): a, c, t, g, unknown or other
  misc_feature (204)..(204): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaanacgccaccctctcctgcagggccagtcagagttgttagcacctcttacgcctggtaccaacagaacctggccaggctcccagcctcctcactctctgatcgccttccgaacgcgggaccacgtcggactacgtccccagtccgtaggttccgaggtcggactagggttcggggtacgtacgggactacgtaccttcacttccaccaacctagttacccgaacgtcccgttaacccgtaaggtccgaccgtttagggttaacgttattttttggtaacgtttttactaacggttgtaccaggtaccgtaagttacgtacgctagtccgttcgggtaccccttaccgtacgggttaccggggcgggttaaacggaccggtagggtacggaacgtactaaccccgtaaaggaccgtttgggacctcggtacgacctaaccgtattccgttcgtttacttacctcgtttccccgtaccccg

SEQ ID NO: 177115 - DNA, 551 bp, Homo sapiens
  misc_feature: GYAE6OF01D2O5F.14.86.H09.1.454.CMB.1.raw
  modified_base (262)..(262): a, c, t, g, unknown or other
  misc_feature (262)..(262): n is a, c, g, or t
  modified_base (362)..(362): a, c, t, g, unknown or other
  misc_feature (362)..(362): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaanagaaacctggccaggctcccagcctcctcatctctgatgcttccaacgagggccactggcactcccagccaggttcaggtcggcagtgggtcgtgggacngacttcgactctcacatcagctcctagcgctggatattttgtagtttattactgtcagtctagtatagctagctcggccctcccgtacgtttccgggacgggtacgggaccgtaagggtcggaacgactacccgaagtacgtggtacggctgacctacgacgttctacgttccttctcttccgtccccg

SEQ ID NO: 177116 - DNA, 573 bp, Homo sapiens
  misc_feature: GYAE6OF01DZVPN.14.86.H09.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (561)..(561): a, c, t, g, unknown or other
  misc_feature (561)..(561): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagcacctcttagcctggtaccaanagaaacctggccaggctcccagcctcctcatctctgatcgcttccaacgacgggcccacgtggcactccccagccctaagggttcaggtcggctaggtgggtctggggacaggacttcactctcaccatcacgtcctccctagacgtccgtggtacgtatttttgtaagttttattacgttgtcagtctagttatagcagtctcggccctcccgtacgtttcgggcggtacgggaccgagggtcggagacgtaccgaacgtaacgtggtggctcggacctaccattccttagtcctttcncttccgttcccg

SEQ ID NO: 177117 - DNA, 628 bp, Homo sapiens
  misc_feature: GYAE6OF01AEDYI.14.86.H09.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangcccaccctctcctgcagggccagtcagagtgttagcacctcttagcctggtaccaacagaacctggccaggctcccagcctcctcatctctgatgctccaacngggccacgtcggcactcccagcctaggttcaggttggcaggtgggtcgtgggacagtacttcactctaccacctatccacgtccctacccgtacgacgtcccgttaggtacgttagttttgttaagttttactttacgttcgttacgtagtcgtaagttatacgcacgtccgtcggtaccctcccgtacggtttccgggacgggtacgggaccgtagggtacggagaccgtaaccgaaccggtaacgtcgggtacggtcgtcggaccctaaccgtacgttccgttacgtttacccttccttaccgttcccgttacccccg

SEQ ID NO: 177118 - DNA, 877 bp, Homo sapiens
  misc_feature: GYAE6OF01EASQ9.14.86.H09.1.454.CMB.1.raw
  modified_base (212)..(212): a, c, t, g, unknown or other
  misc_feature (212)..(212): n is a, c, g, or t
tcagcgtctagtaccacgaccggtgctcgatttagtgctatagacttggggtttgggggaggaactgctcagttaggacccagagggaaccatggcagcccagctcagcttctcttcctcctgctactctggcctccagatatcgaccggagtaaattgtgttgacacagtctccacgccacccttgttctttgtcctaccgaaggggaaancgccctaccctctccgtgcgagggccagtcagtagttgttacgcctaccttccgttagccgttacggtaaccaaacgaacggtaaaacccgttcgggacccgtaacgggtcccttacccgaacggtcccttaccctactaacttccgtaccgttacgtaacttccggtaccctttaaccggaaaccggtaccggggacccctaacggttcggacctaacccgtaccccgaacggtacccgttaagggttccgtaagggtcgggtaccggtaagggttcggggtacggtacggggtaacctacggttaccttaccaccgttcctaccgaaccgtacgtaccgaacggtaccccttaacccggtaacggtaccggtaccggttagggttaacgtttttacggttttttacggtttaaacgtttttacgttaaccggttcggttaaccgtaacggttaccgttaaagttacgtacggtaccgtaaccggttccggtcccggttaacccctttcccggttaacgggtttccgggaaccggggtaacggtaaccgtaggggtaccgaacgtacccgtaaccggaaacggtacggttcgggtacggtacgtacgaccttaaccgtacgtttccgttacgttacctttaccgtacccgttccccgttacccg

SEQ ID NO: 177119 - DNA, 683 bp, Homo sapiens
  misc_feature: GYAE6OF01ANXX4.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaanacgcccaccctctcctgcagggccagtcagagtgttagcacctcctagcctggtaccaacagaaacctggccaggcctcccagcctcctcactctctgatcgccttaccaacgagggcccaacgtcggacacctccccgagccgtaggttccaggtcggctaggtcgggtctaggggacaggtacctcacctctacaccatcacgtccttacccgtagacgtccgtaggtagttagtttttagtaacgttttattacgttacggttactaacggtcgtaaggttactacggtactaacgttcgtaccgggtaccccttaccccgttacggtttccggggaccgggtaacggggtaacccaagggggtcgaacggtaacgtacccggtaaaacggtccgttcgggtacgggtactaccggtacctaacccgtcgtttaccgttcgtttacctttaccgtaccgtttccccgttacccccgg

SEQ ID NO: 177120 - DNA, 173 bp, Homo sapiens; identical to SEQ ID NO: 177079
  misc_feature: GYAE6OF01EU1B1.14.86.H09.1.454.CMB.1.raw
  modified_base (173)..(173): a, c, t, g, unknown or other
  misc_feature (173)..(173): n is a, c, g, or t

SEQ ID NO: 177121 - DNA, 739 bp, Homo sapiens
  misc_feature: GYAE6OF01BZQYM.14.86.H09.1.454.CMB.1.raw
  modified_base (204)..(204): a, c, t, g, unknown or other
  misc_feature (204)..(204): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctccagatatcaccggagaaattgtgttgacacagtctccagcccacctgtctttgtctccgaaggggaanacgccaccctctccgtgcgagggccagtcaggtagttgttacgcctaccttcgttacgccgtacggtaacccaaaacgaacgaaaacccgtcgggacccgaaggtccctaccccgacgtcccttaccctactacttcctacgtagtactccgaccttaccgaacgacggtaccacgtcggaccactcccgagtccgtaggttccgaggtcggacgtagggtgggtacgagggtacacggttaccttcactctaccaactataccgacgtccctaccgtaggacgccgttaggtacgtttagttttacggttaagttttaacttaagttacgtacgtacgtacgtagtaatacgacgtacgtccgtaccgtacccgtacccgtaccggtttacggggaccgggtaacgggtaacccggtaagggtaccgggtaaacgtaacggtaacccggtaaaccggtaacggtcggtacggtcgtacggacccgtaccgtactttccgttacgttaccttaccgttccgttcccgttaacccg

SEQ ID NO: 177122 - DNA, 665 bp, Homo sapiens
  misc_feature: GYAE6OF01EK278.14.86.H09.1.454.CMB.1.raw
  modified_base (208)..(208): a, c, t, g, unknown or other
  misc_feature (208)..(208): n is a, c, g, or t
  modified_base (597)..(597): a, c, t, g, unknown or other
  misc_feature (597)..(597): n is a, c, g, or t
tcagcgtctagtaccacgaccggtgctcgattttagtgctatagacttgggtttgggggaggaactgctcagttaggacccagagggaaccatggcagccccagctcagcttctcttcctcctgctactctggctcccagatatcaccggagaaattgtgttgacacagtcctccagccaccctgttctttgtctccgaaggggaaancgcccaccctctcctgcacgggccagtcagagttgttacgcctacctccttagccgtaggtaaccaaacgaacggaaaaccctcggacccacggcctcccgagtccctcctcacttctccgtgacttcgcctttaccgaaccggacggggaccctaacgtcggacctaccgtaccccgacgtccggtaacggtttcacgggttcggccgtagggttcgggtcgtggggacacggtacttcctactcctaccgacctatccgacgtcccttacccgagtacgtcgtacggtaagtttagttttagtaagttttattacgttcgtactagtactagtactagacgtacgcgtcggtcccttcgtacgttcgggacggtacggacgtagggngtacgacgtaccgaacgtacgtggtagcgtcgaccacctcgtcttgttaccttctccgttccgtcccg

SEQ ID NO: 177123 - DNA, 654 bp, Homo sapiens
  misc_feature: GYAE6OF01CGDNL.14.86.H09.1.454.CMB.1.raw
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
tcagcgtctagtaccacgaccggtgctcgatttagtgctatagacttgggtttgggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctcctgtcgccccacatggacacactttgctacacactcctgctgctgacccncccttcctggtcttgtcccaggtcaccttgaaggngtctggtcctgtgctggtacgaaacccacagacgaccctcacgctgacctgccaccgtctcgtcgggttctcactcagcaatcctaagtaagtcgggtgtgagcgtaggtactccgtcgaccggaccccccgggaacggcccgtgggacgtcgggtcttcgaccgtaactaactttacgttttttacgaagttacgtaaaccgtaaaaatttcgtaactaacgacctaaccgtacttccgttacgttaggacggtacgtaccgtacgttaccgtacctaaccgtaacgttaccttaaccccgacggtaaccctaaccccgttacccaaacgaccgacccgtaacggttaccgttacccgttaaacccg

SEQ ID NO: 177124 - DNA, 545 bp, Homo sapiens
  misc_feature: GYAE6OF01CF2IN.14.86.H09.1.454.CMB.1.raw
  modified_base (261)..(261): a, c, t, g, unknown or other
  misc_feature (261)..(261): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccagggggaaagagccaccctctcctgcagggccagtcagagtgttagcacctctagcctggtaccaanagaacctgccaggctccagcctctcatctctgatgcttccaacgaggccactggcatcccagccaggttcagtggcagtgggtctgggacagacttcactctcacatcagctccctagacgccgtaggagttattttgttaagtttattactgtcagtcagtatagctagctcggcctcccgtacgtttcggacggagggaccgaaggtggagactaccgaaacgtaacgtcggtaggctggaccaccgtagttacttcgttacttcctattcccgttaccccg

SEQ ID NO: 177125 - DNA, 605 bp, Homo sapiens
  misc_feature: GYAE6OF01BO983.14.86.H09.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaangccaccctctcctgcagggccagtcagagtgttagcacctcttagcctggtaccaanagaaacctggccaggcctcccagcctcctcatctctgatgcttccaacgcgggccacgtcggcactcccagcctaggttcaggtggcaggtgggtctgggacagtcttcactctcaccatcagtcctcctagacgtccgtggtagtatttttagtaagttttatacgttgttacagtactagtatgacagtccgtcgggcccttacccgtacgtttaccggggacggtaacggggacccgtaagggtcggaaggtactacccgaaacggtacgttcggtacgggccttggaccctaaccgtacgttcccttacgttaccctttcctacgttcccccgtttccccgg

SEQ ID NO: 177126 - DNA, 543 bp, Homo sapiens
  misc_feature: GYAE6OF01BS47V.14.86.H09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctcttagcctggtaccaanagaaacctggccaggctcccagcctcctcatctctgatgcttccaacagggctactggcatcccagcctaggttcagtggcaggtgggtctgggacagacttcactctcacatcagcctccctagacgccgtggatattttgtagtttattactgtcagctagtatagcagctcggcccttccgacgtttcgggcggtagggaccagggtcgagtactaccgaaacgtacgtggtacggctcgccaacccattccgtgttaccttcgacttcccgttaccccg

SEQ ID NO: 177127 - DNA, 752 bp, Homo sapiens
  misc_feature: GYAE6OF01AM8RD.14.86.H09.1.454.CMB.1.raw
  modified_base (205)..(205): a, c, t, g, unknown or other
  misc_feature (205)..(205): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcaggccagtcagagtgttagcacctcttagcctggtaccaacagaaacctggccaggcctcccagccctcctcactcctctgacttcgccttaccgaacgacgggccacgtggaccacgtccccgagtcccgtaaggtttcaggttcggacgtagggttcggggtctacggggaactacggtacctttcgaaccgttcctaccgaaccctataccacgtcccttaccccgtaggtaccgtcccgttagggtaacgtttaacgtttttacggtttaacgttttaactttaccgttagttaccgtaacggttaccgtaagttaacgttacggacctaacggtccgtttacgggaccccctttaccccggttacgggtttttacccggggaccgggtaaacggggttaacccggtaaggggttcgggaacggtaccgtaacccgaaacgggtaaccgttcgggttacgggtcttacggaccgtaaccctcgttaccgttacgttcccgtttaccgtacctttccccggttaccccg

SEQ ID NO: 177128 - DNA, 662 bp, Homo sapiens
  misc_feature: GYAE6OF01A9E06.14.86.H09.1.454.CMB.1.raw
  modified_base (204)..(204): a, c, t, g, unknown or other
  misc_feature (204)..(204): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagccacctccttagcctggtaccaacagaaacctggccaggctcccagcctcctcatctctgatcgccttccaacgcgggccacgtggaccacgtccccaggcccctaagggtttcaaggtcggactaggtcggggtctggggactaggtacttcacttcgtaccacctatccacgtccctacccgtaggacgtccgttagggtaacgtttagtttttacggttaagttttactttaaccgttcggttacaacggtactaaggttaactacggactaacggtccgttcggtaccccttccccgtaacggttttcggggaccgggtacgggtaaccgtagggtacggaacgtacgtaccgaaagtaccgtggtaggcttcgacctactacgttcgtcgttaccttcgtaccgttcccgttaccccg

SEQ ID NO: 177129 - DNA, 755 bp, Homo sapiens
  misc_feature: GYAE6OF01BNKNN.14.86.H09.1.454.CMB.1.raw
  modified_base (202)..(202): a, c, t, g, unknown or other
  misc_feature (202)..(202): n is a, c, g, or t
  modified_base (393)..(393): a, c, t, g, unknown or other
  misc_feature (393)..(393): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgctccgaggggaancgccaccctctcctgcagggccagtcagagtgtagcacctcttagcctggtaccaacagaacctggccaggcctcccagccctcctcactctctgatcgccttaccaacgcgggcccacgtggaccacttccccgaggtcccaggttccaggtggactagggtgggtctgggacaggtaccttcgacttcncaccgatccgacgtcctacccgtagacgtaccgttagggtacgtttacgtttttaggtttaacgttttaacgtttaaccgttacggttaccgtaaggtaccgttaaaggtttaacgttaacggaccgtacggttcccggttccggtacccccttacccccggttaacggtttttcccgggggaaccggggttaaccggggtaacccgtaaagggggttcgggtaaacgtaacccggttacccgaaaaccgggttaacggttacggggttacgggaccgtttcgggaaccccttacccgtaacgtttacccggtttacgtttaccccgtttacgttaccccgtttccccggtttaaccccccg

SEQ ID NO: 177130 - DNA, 696 bp, Homo sapiens
  misc_feature: GYAE6OF01DFDC6.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccagcccacctgtctttgtctccgaaggggaancgcccaccctctcctgcgagggccagtcagagtgttacgctaccttcctagccgtacggtaaccaacgacgaaaccgtcggaccacggcctcccgacgtccctcctcactctctgactcgtccttaccgaacgcggaccacgtcgactacgtcccgagccgtaaggtcaaggtcggacgtaggtcgggtcgagggtacctagtaccttacacgtccacactatcgacgtcctaccgagcgtcgtaggtacgtttagttttagtagtttacgtacgtgtacgaagtcgtagtacgacgcgtacgtccgttaccgtcccttaccggttacgggttaccggggaccgggtaacgggtaacccgtaaggggtaccgtaacggtacctaaacccggtaaacggtaaccgttcgggtacgggacccttacggtacccgtaaccttacggttccgttaccggtttaccctttacccgtacccgtttccccggttaccccg

SEQ ID NO: 177131 - DNA, 659 bp, Homo sapiens
  misc_feature: GYAE6OF01C3UAJ.14.86.H09.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagcacctcttagcctggtaccaanagaaacctggccaggcctcccagccctcctcatctctgatcgcttccaacgngggcccacgtggcactcccagccgtaggttcaggtggctaggtgggtcgtcgggacagtacttcacctctacacctatccagtcctacccgtagacgtccgttaggtacgttattttttggttaacgttttaacttaccgttggttactacggtcgtaagttaacgttacggccgttaaggtccgttaccgggtcccctttaccccgttaaccgggtttttccggggaccggggtaacgggtaccgaaggggttcgggaacgtacgtacccgaaacggtaacgtgggtcggcgttcgaccctacctacgttcgttacgttcctttaccgcgtttcccgttaccccg

SEQ ID NO: 177132 - DNA, 563 bp, Homo sapiens
  misc_feature: GYAE6OF01EY9LB.14.86.H09.1.454.CMB.1.raw
  modified_base (312)..(312): a, c, t, g, unknown or other
  misc_feature (312)..(312): n is a, c, g, or t
  modified_base (485)..(485): a, c, t, g, unknown or other
  misc_feature (485)..(485): n is a, c, g, or t
tcagcgtctagtaccacgaccggtgctcgatttagtgctatagacttgggtttgggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctcctgtgccccacatggacacactttgctacacactcctgctgctgaccaccccttctgggtcttgtcccaggtcaccttgaaggagtctggtcctgtgctggtgaaacccanagacgaccctcacgctgacctgcaccgtctcgtgggttctcactcagcaactcctagaatgggtatgagtctggactccgtcgacggacccccgggaggcccgtggacgtggcttcgcactactatttttacgaatagaacaaaattcaacagacactactctctagaggacncgtaacgtcctacacctacgtaactacccgaaggaccaccctaccctaaccgacgacccgaggtacgtaccttaaccg

SEQ ID NO: 177133 - DNA, 550 bp, Homo sapiens
  misc_feature: GYAE6OF01D9VD2.14.86.H09.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaangccaccctntcctgcagggccagtcagagtgttagcacctcttagcctgtaccanagaaacctgccaggctccagcctcctcatctctgatgcttccaacacgggccacgtgcatcccagccaggttcaggtgcagtgggtctgggacagatccacgtctcacatcagctccagntcctggatatttgatttattacngtcagctagtanagtcagcgttcgccctacccgtagtttcccgggcgggtaacgggacctaaggggtggaacgtccgtaccgaaacgtacgtcggtcggtctcggaccacccgtagtcttacgttaccgttactacgtcccttaccccgg

SEQ ID NO: 177134 - DNA, 785 bp, Homo sapiens
  misc_feature: GYAE6OF01BRIZZ.14.86.H09.1.454.CMB.1.raw
  modified_base (200)..(200): a, c, t, g, unknown or other
  misc_feature (200)..(200): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccacctgtctttgtctcaggggaancgccacctctcctgcagggccagtcagtagtgttacgctacctccttagcctaggtaccaacacgaaaccgtggaccacggcctcccacgcctcctcactctctgatcgccttaccaacgacgggcccacgtggacctactacccgagccgtaggttacgaggtcggacgtagggtcgggtcgtagggactaacggtacctttaccacgtttccctaccgtaaacctacgtaccgtacggtaccccttacccgtaaggtaccggtcccgttaagggttaacgttttagttttttacggttaacgtttttaacgttaacgtttcgggtaactacggtaccgttaagttacgtacgacgtacggtccgttccggtaccccctttaccgttaccggggtttaccgggggaccgggttaaaccggggtaccggtaaacggggtcgggtaaacgtaaccgtaaacccgggtaaaacgtaccgggtttcgggtacccgggacgttaccggacccctaaccgggtttaactttcccggttacgttttaccccgtttaccgtaaccccgttttccccggtttaaaccccccgg

SEQ ID NO: 177135 - DNA, 749 bp, Homo sapiens
  misc_feature: GYAE6OF01AMFOS.14.86.H09.1.454.CMB.1.raw
  modified_base (200)..(200): a, c, t, g, unknown or other
  misc_feature (200)..(200): n is a, c, g, or t
tcagcgtctagtaccacgaccggtgctcgatttagtgctatagacttgggtttgggggaggaactgctcagttaggacccagagggaaccatggcagcccagctcagcttctcttcctcctgctactctggctcccagatatcaccggagaaattgtgttgacacagtctccacgccacctgtctttgctcgagggtaancgccacctctcctgcgagggccagtcagagtgttacgctacctctagcctaggtaaccaacacgaaaccgtggaccaggctccacgcctcctcatcctctcgactgccttaccgaacgtacgggcccacgtcggacctactacccgacggtcctaacgggttcaaggtcggcgtaacgggtcggggtcgtaggggactaacggttacttaccgaccttctacccgtaacctacgtccgtaaccggtcccgttacccgtaacggtaccggtaccgtacggggttaacgtttaacgttttttacgggttttaacgttttaacgtttaccgtttacggtacgttaaggtaccgttaaagtaccgtaacggtacgtacgtcccgggttccgtaccccgttcccgtaacgggttttcccgggaacgggttaccgggaaccgggtacgggtacgggaacgtaccggttacccgaaacggttaaccggtcgggttcgtacggtccggaccgtactaacgttcggttacttcctttaccgtcgttccccgttacccg

SEQ ID NO: 177136 - DNA, 803 bp, Homo sapiens
  misc_feature: GYAE6OF01BP0AM.14.86.H09.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (351)..(351): a, c, t, g, unknown or other
  misc_feature (351)..(351): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagtaaattgtgttgacacagtctccagccacctgttcttgtctaccgaaggggaaancgcctaccctctccngcgaggccagtcgagagtgttacgcctacctcttagcctaggtaacccaactacgaaacccgtgggacccaggcccttacccacgtccctccctacacttccgtactgtattcgaccttacccgaaacgngggtccctacgtggaccaacgttccccgaagtccgtaagggttccagggttcggacctaaggggttcgggtcgttacggggacctaggtaacctttccgacttcccactaacctacttcgaaccgtcccttacccgtacggacggtaccgttagggtaagtttacgtttttacggttaagttttaacttacggtttcgtacgtaacggtacgtttaaggttaacgaggtaccgtacggtccttaccgggtaacccccttcccttaaaccgggggttttccgggaacccgggggtaacgggtaaccccgtaaaggggttaccgggtaaaggtaacccgtaaacccggtaaaacgggtaaccgtcggggttaacgacccgttacggaacccgtaacccgttacgtttcccgttacgtttaccggttcccttaaaggtttccccccgttaacccg

SEQ ID NO: 177137 - DNA, 770 bp, Homo sapiens
  misc_feature: GYAE6OF01DVXHK.14.86.H09.1.454.CMB.1.raw
  modified_base (203)..(203): a, c, t, g, unknown or other
  misc_feature (203)..(203): n is a, c, g, or t
  modified_base (751)..(751): a, c, t, g, unknown or other
  misc_feature (751)..(751): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaancgccaccctctcctgcagggccagtcaggagtgttacgctaccgtcttagcctacggtaaccaacgacgaaacctcggaccaggcctcccagccctcctcactccttactggtactcgtcttacccgaaacgacggggacccacggtcgggaccaccgttaccccgaacgtcccgtaagggttccgaacgggtcggccgtaagggttcggggtacgtacggggaaccgaggtaccttaccgtacctcttaccaaccgaacttacgaccggtacctacccgtaacggaccggttaccgtagggttaacttttagtttttacggtttaacgtttttaacttacggttgttaccgtaggtaccgttaagttaacgtacgtacgtaacgtccggtttacccggacccctttacccggttaccgggtttccggggacgggtaaccgggtaaccggagggttaggtaacgtaccgtacccgtaaacggtaaccgttcgggtaggtccgtacggaacccttaccgtaacgtttcccggttacttccggtttaccnccggtttcccctaccccgg

SEQ ID NO: 177138 - DNA, 849 bp, Homo sapiens
  misc_feature: GYAE6OF01BB3ZK.14.86.H09.1.454.CMB.1.raw
  modified_base (204)..(204): a, c, t, g, unknown or other
  misc_feature (204)..(204): n is a, c, g, or t
tcagcgtctagtaccacgaccggtgctcgatttagtgctatagacttgggtttgggggaggaactgctcagttaggacccagagggaaccatggcagccccagcctcagcttctcttcctcctgctactctggctcccagatatcaccggagaaattgtgttgacacagtctccagccaccctgtctttgtctccgaggggaanacgccaccctctcctgcagggccagtcagagtgttagccacctctagcctggtaccaacagaacctggccaggcctcccagcctctcatctctgactcgtccttaccgaaacgtcggggccctaacgtcggacctacgtacccccgaaggtccccgtaagggttttaccgaagggtttcggggaccgtaaggggtttacgggggtccgttacggggggaaccctaacgggttaaccctttcctaaacccgtttcccgttaaacccgtaaccccgtaaacttcccggtaaccggtttccccctttacccccggttaaaggtaaccccggttccccgggtttaagggggttaaacgtttttaacggtttttttaacgggtttaaacggttttttaaacgtttaccggtttacggttaccgtaacggtaccgttaaaggtttacgtacggtaccgttacggtaccggttccggtacccccttacccggttaccgggttttaccggggaccggggttaacgggaacccgtaaggggttacggaacggtaccgttaccggaaacggtaacggtcggtacgggtacctaccggcctaacccgttacgttccgttacgttacccgtaccttacccgttccccggttaccccg

SEQ ID NO: 177139 - DNA, 584 bp, Homo sapiens
  misc_feature: GYAE6OF01EC7MA.14.86.H09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctcttagcctggtaccaanagaacctggccaggctcccagcctcctcatctctgatgcttaccaacgngggccactggcatcccagccaggttcaggtggcaggtgggtctgggacagtacttcactctacaccatcacgtcctccgtagacgccgtaggtagttattttagtagttttattacgttgttacagtactagtatacgcgagtctcggtcccttacccgtacgtttccgggaccgggtacgggtaaccgtaagggtacggaacgtacgtaccgaaacgtacgtggtcggctcgacctaccacttctacgttaccttctacgttcccgttaccccg

SEQ ID NO: 177140 - DNA, 561 bp, Homo sapiens
  misc_feature: GYAE6OF01ATXUT.14.86.H09.1.454.CMB.1.raw
  modified_base (309)..(309): a, c, t, g, unknown or other
  misc_feature (309)..(309): n is a, c, g, or t
  modified_base (500)..(500): a, c, t, g, unknown or other
  misc_feature (500)..(500): n is a, c, g, or t
tcagcgtctagtaccacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctcctgtcgccccaccatggacacactttgctacacactcctgctgctgacccaccccttctgggtcttgtcccaggtcaccttgaaggagtctggtcctgtgctggtanaaacccacagacgaccctcacgctgacctgccaccgtctcgtgggttctcactcagcaatcctagtaatgggtgtgagcgtggactccgtcgaccggcccccggggaacggtcccgtggacgtcggcttgcactacttactttttacgaatgaactaaaacttctaacacgcactactctcgtagaggacncagtcctacaccactacacccacgaccaccctaccaacacgaccacggtacgtccctaacc

SEQ ID NO: 177141 - DNA, 821 bp, Homo sapiens
  misc_feature: GYAE6OF01CF0CT.14.86.H09.1.454.CMB.1.raw
  modified_base (204)..(204): a, c, t, g, unknown or other
  misc_feature (204)..(204): n is a, c, g, or t
  modified_base (808)..(808): a, c, t, g, unknown or other
  misc_feature (808)..(808): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaancgccacctctcctgcgagggccagtcagtagtgttacgcctaccttaccgttacgccgttacgggtaacccaaacgaacggtaaacccgttcgggacccgaagggtccctaccccgaacggtcccttccctacaacttccgtcgttacggtaactccggtacctttacccgaaacggtaccggggccctacggttacggacctaaccgttaccccgaacgtacccggttaagggtttaccgaacgggtccggggtaccgtaggggtttccgggggttacccgagggggtaacctacggttacctttaccgaacccttacccgtaaccgaacctacttcccgaccgtcccttaacccgtaggaccgtccgttaacgggtagttttaacgtttttagttaacgttttaacgttccgtagtaccgtaagtaccgtaaggttacgtacggaccttaacgggtcccgttaccggtacccccttacccgggttaccgggtttaccggggaccggggtaacgggtaccggtaagggtacggaaccgtaacgtacccggaaacggtcggttcggacgtactcggacctacgtacgttctacggttcttaccncgttccctacccg

SEQ ID NO: 177142 - DNA, 783 bp, Homo sapiens
  misc_feature: GYAE6OF01CSVMU.14.86.H09.1.454.CMB.1.raw
  modified_base (209)..(209): a, c, t, g, unknown or other
  misc_feature (209)..(209): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagtaaattgtgttgacacagtcctcacgcccacctgttctttgtctaccgaaggggaaancgcccaccctctcctgcgacgggccagtcagtagtgttaacgcctaccttccttacgccgtacgtaaccaaacacgtaaaacccgtggacccgacggtccctacccgacgcccttaccctcacgttcctcgtcgtactcgtacccttaccgaaacgaccggggtaccctacggttcggaccaacctccccggtacgcccggtagggtttaccagggtcggacgtaggggtcgggtcgtacgggaactacggtaccttctaccgtcctaccaccttactaccgtacgtcccttacccgtaaggtccgtaccggttaggttaacgttttacgttttttagtttaacgttttaaactttccgttcggtaactacggtactagttaacgtacgacgtaacgtccgttccgggtaacccttccccggtttaacgggttaccggggaacgggtaacgggttaaccgtagggggtacctaacggtaacccgtaacccgtaaaggtaccgttcgggaccggttcctaccggacccgttactagtttccggttattccctttactaccgtttcccgttacccg

SEQ ID NO: 177143 - DNA, 876 bp, Homo sapiens
  misc_feature: GYAE6OF01A2YS2.14.86.H09.1.454.CMB.1.raw
  modified_base (205)..(205): a, c, t, g, unknown or other
  misc_feature (205)..(205): n is a, c, g, or t
tcagcgtctagtaccacgaccggtgctcgatttagtgctatagactttggggtttgggggaggaactgctcagttaggacccagagggaaccatggcacgccccagctcagcttctcttcctcctgctactctggcctcccagatatcgaccggagtaaattgtgttgacacagtctccagccacctgtctttgctcgagggaancgccacctctccgtgcgacgggccagtcaggtaggttgttacgcctacccttccgttacgccgttacggtaacccaaacgaacgtaaacccgtcgggacccgacggccctacccacgtcccttcctactacttcctctagacttcgtacccttacccgaacggaccgggtccctacggtcggaccactccccgagtacccgtaggttcgaggtcggaccgtagggttcgggtacgtaggggacctacggtaccttaccaccgttcctaccgtaaccctagttacccgaccggtaccctttacccgaagggtcgtaccgggttagggttacgttttaacgttttttagggttaacgtttttacttaaccggttggttaccgtaagggtacccttaaaggtttacgtaacgggtacctaaccgggtccggtttccccggtaaccccgtttaccccgggtttaaccgggttttaccggggggaacccgggggttaaacgggtaaccgggtaaacgggggttcggaaaaccggttaacccgttaaaccccgggtaaaacggttaccgggtttcgggtccggggtacccgttacccggaacccctttaaccgttaccgtttaccggtttaccgttttaacccttacccggttacccgtttcccccggttacccccg

SEQ ID NO: 177144 - DNA, 726 bp, Homo sapiens
  misc_feature: GYAE6OF01ELMC8.14.86.H09.1.454.CMB.1.raw
  modified_base (151)..(151): a, c, t, g, unknown or other
  misc_feature (151)..(151): n is a, c, g, or t
  modified_base (559)..(559): a, c, t, g, unknown or other
  misc_feature (559)..(559): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccgganaaattgtgttgacacagtctccagcccacctgtctttgtctacgagggaagcgccaccctctccgtgcgacgggccagtcaggtacgttcgttacgcctacccttccgttacgaccgttacggtaacccaacgtaacgtaaaccctcgggacccacggtccctcccacgtccctcctcgtactcctctggtactccggtaccttaccggaaaccgcgggtacccacggtcgacctaacgtccccgagtacccggtaggttcgacggtcggacgtcgggtcgggtccgtagggacctacgtacctcacgtccacgacctactacaccgtcctaccggtagtaccggtacctgggttaatttacgttttaggttacttttacgtacttcgtagtaaccgtactaggtacncggccctgtcccgtaccggtccccgttaacggtccgggttacggggtaccggaaccgggacgtaacgggttacggacgtaacgtaaaccggacggtaacggttggaccgtcccgacgtccgtaccgttactcgttacccggttaccttccggtcctcccgtacccgg

SEQ ID NO: 177145 - DNA, 708 bp, Homo sapiens
  misc_feature: GYAE6OF01BQ4ER.14.86.H09.1.454.CMB.1.raw
tcagcgtctagtaccacgaccggtgctcgatttagtgctatagacttgggtttgggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctctgtcgccccaccatggacactactttgctacacactcctgctgctcgaccctaccccttcgtcgggttcttcgtcccgaggtccaccgttaggaacggtagttcgttcggtcccttggtcgtccgttgggtaaccgaaaacccgacgaacggaccgacccctcgaccgtcctcgacccgtcgacctacccgttcttccggttcggtttcctacacctacgacgacctaaacttaccgtaaggtaacggttgggggttacgtacggacgtccgtagggtacccgtacccggtaccgaccccgggtaccccccggggacggtaccccggtagggtacggtcggtcgttcgacctacgtactttacgttttacgaagtaacgtaacgtaaaccttctaacgtacgactacgtacttcgtagtcgacggactacgtacgtcctacctacgtacttaccgaaccgtaccgaaccctacctaccacgtacgacgtacggtccgtcctaacccg

SEQ ID NO: 177146 - DNA, 806 bp, Homo sapiens
  misc_feature: GYAE6OF01DN54R.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccaaccacctgttctttgtctccgaggggaaanacgccaccctctcctgcgagggccagtcagagtgttacgctacctccttagcctaggtaaccaacacgaaacctcggaccaggcctcccacgccctcctacactcctctagactcgtaccttaccgaacgacgggccctacgtcggacctaactccccgaacgtcccgtacggttcgaaggtcggacgtacggttcggggttacgtacggggactacggtacctttccgaaccttcctaccgaacctacttccgacggttaccccttacccgtaaggtacccggttccgttaagggttaacgttttaagttttttacggtttaaacgtttttaaacttaccgtttacggtaacgtacggttaacgttaacggtttaaccgtaaggttacccgaagggttcccttaaccggggtccccctttaaccccgggtttaccggtttacccgggggacggggtaaaccgggtaacccgttaaagggggtcgtaaaacgtaccgttaaacccggaaaacggttacggttacgggtcgggtacccttcggaacccttaacccgttgttaccgttacggttaccttacctaccgtttcccgtaaccccggtc

SEQ ID NO: 177147 - DNA, 676 bp, Homo sapiens
  misc_feature: GYAE6OF01DCLJO.14.86.H09.1.454.CMB.1.raw
  modified_base (205)..(205): a, c, t, g, unknown or other
  misc_feature (205)..(205): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (658)..(658): a, c, t, g, unknown or other
  misc_feature (658)..(658): n is a, c, g, or t
tcagcgtctagtaccacgaccggtgctcgatttagtgctatagacttgggtttggggggaggaactgctcagttaggacccagagggaaccatggcagccccagctcagcttctcttcctcctgctactctggctcccagatatcaccggagaaattgtgttgacacagtctccagccaccctgtctttgctccgaggggaaagngccaccctctcctgcagggccagtcagagtgtagcacctctagcctgtaccaanagaacctggccaggcctccagcctcncatctctgactcgtccttacccgaacgacgggcccacgtcggccacgtccccgaagtcccgtaagggttccaggtcgggctaggggttcggggtacgtcggggacgtaacggttaccttaccgaaccttcgttacccaacctattccacggtccctacccgtagacgtaccgttagggtaagtttacttttttggttaagttttaactttacgttgtacctagtacgagttatacgctagtccgtcgtcccgttacccgttacggtttcgggacggggtaacgggaaccggtagggtacggaacgtaccgtaccgtaaacgtacgttcgggtaggccgtcgacctaaccgtacgtttcgttacgttctttccncgtttccccgttaccccg

SEQ ID NO: 177148 - DNA, 768 bp, Homo sapiens
  misc_feature: GYAE6OF01EEU1I.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccagccacccttgttctttgtcctccgaaggggaaacgcgcccaccctctccgtgcgacgggccagtcagtagttgttacgcctaccttcgttacgccgttacggtaacccaaacgaacggaaacccgtcggacccgacggtcccttacccgacgtcccttaccttctaacttccttacgtaggtacgttcggtacccttaaccgaaacggtaccgggccctacggttcggacctaccgtccccgaacggtcccgtaagggttctaacgggtcggacgtaggggttcgggtacgacggggaactacggtacccttacgaccttacctaccaccgtataccgtacgtacccttaccgtaacggccggtaccgttagggttaactttagtttttacggtttaagttttactttacgtacgttactagttacgtaagttaacgtacgtacgtacgtccgtccggttaccccttacccggttacgggttccggggaacgggtaaccgggtaacgtacggggtagaaccgtacgtaaccggaagtaccgtcggtacgctacgcctaactcgttcgttcgttaccttcgtccgttccgtacccg

SEQ ID NO: 177149 - DNA, 773 bp, Homo sapiens
  misc_feature: GYAE6OF01D6PEV.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaaggggaagacgcccaccctctcctgcgagggccagtcagagtgttacgcctacctcttagcctggtaaccaacgagaaacctggaccacggcctacccagtccctcctcactcctctgactcgtccttaccgaacgtcggcccacgtcggcactcccgaagccgtaggttcaggtggacgtaggttcgggtcgtaggggtaactacggtacctttaccaccgttacctacccgtaacctaacgtccgtacgtcccgttacccgtaggtacgtacccggttagggtaacgtttagtttttaggttaacgtttttacgtacgtttgtacgttacgacgttagttaacgtacgtacgacgtacggtccggtaccccttcccggttaccggtttaccggggaaccggggtaacgggtaacccggtaaggggtaccggtaacggtaaccgttaaacccggtaaaccggttaccggttacgggtaccggttaccggtacggtaaccccttaccggtaaaccgtttcccgggtttacgtttaacccgttttccctaacccggttttccccccgttaacccccgg

SEQ ID NO: 177150 - DNA, 554 bp, Homo sapiens
  misc_feature: GYAE6OF01B6K6X.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcactcttagcctggtaccaacagaaacctggccaggctcccagcctcctcatctctgatgccttccaacacgggccactggcatcccagccaggttcaggtggcaggtgggtctgggacagtacttcactctcacatcagcctccctagacgtcctaggagtatttttcgtaagttttacttacgtgtctagccaagtatagcagctcggcccttcccgacgtttcggcggagggaccgtaaggtcggagactaccgaaacgtaacgtggtggctcggacctaacacgttctgtacctttcacgtccttaccccg

SEQ ID NO: 177151 - DNA, 744 bp, Homo sapiens
  misc_feature: GYAE6OF01COJC7.14.86.H09.1.454.CMB.1.raw
  modified_base (205)..(205): a, c, t, g, unknown or other
  misc_feature (205)..(205): n is a, c, g, or t
tcagcgtctagtaccacgaccggtgctcgatttagtgctatagacttgggtttggggggaggaactgctcagttaggacccagagggaaccatggcagccccagctcagcttctcttcctcctgctactctggctccagatatcaccggagaaattgtgttgacacagtctccagcccaccctgtctttgtctccgaggggaaancgccaccctctcctgcagggccagtcagagttgtagcctaccttctagcctaggtaccaaagacgaaacctggaccaggcctcccagcctcctctactcctcgtgtactcgtaccttaccgaacgacggggtaccctacgtcgggacctaactccccgaagtcccgtagggttccaggttcggacgtaggtcgggtcgtagggacaggtcttacactctcaacctgtaccagtccctacccgtaaggcgtaccgtagggtaacgtttagttttttaggttacttttaaacgttccgttacgggttaccaagggttacgtaaggttaacttacggaccgttagggttaccgttcccggacccctttaccccggttacggggtttcccggggaaccggggtaacggggttaaacccgtagggggttacggtaacggtaacctacccgggtaaacggtaaccggtttcgggaccgacggttacgaccctacggttacctttccggttacgttacctttacctaccggtttccccgtaccccg

SEQ ID NO: 177152 - DNA, 578 bp, Homo sapiens
  misc_feature: GYAE6OF01EXW72.14.86.H09.1.454.CMB.1.raw
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtcctccagccacccttgtctttgtctccgaggggaagagcccaccctctcctgcgagggccagtcagagtgttagctacctcttagcctaggtaccaacagaaacctggccaggcctcccagcctctcatctctgactcgcttaccaacgcgggcccacgtcggcactcccagccaggttcagtgcaggtgggtctggacagtcttcnctcncactatcacgtcctccgtagcgtccgtggtagttattttaggttatttacgtactgtactaggtctagtatacggctagtcgtcggcccttacccgtacgtttccgggacggagggtaccaagggtcggaacgtacgtaccgaagtacgtcgtaggcttcgactacctagttccgtgttacctctcgtcccttacccg

SEQ ID NO: 177153 - DNA, 761 bp, Homo sapiens
  misc_feature: GYAE6OF01AFF3T.14.86.H09.1.454.CMB.1.raw
tcagcgtctagtaccacgaccggtgctcgatttagtgctatagacttggggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaagcgcccaccctctcctgcagggccagtcagagtgttagcacctccttagcctggtaaccaacgagaaacccgtggccacggctcccagccctcctcatcctcgtcgatgcctaccaacgacgggcccacgtggaccacgtccccgaggccctaagggttccaggtcgggacgtagggtcggggtccgtaggggaacctaaggtaccttccgacgttcctaccaaccgtactccacgtaccctcccgtacgacgtaccgtcggtacgttacgttttaggttaacgttttactttacgttacgtactaacgtaccgtaagtaacgtaggaccgtacggtccgttaccgggtccccgttaccccgtaccggttttacccggggacggggtaaccggggtaacccggtaacggggtacgggtaacggtaccggttaaacccggaaaccggttaacggttacgggttaccgggtaccggttaccggtaaccccgtaacccgtacgtttacccgttacggtttaccctttaccggttacccgtttccccgtttaaccccccgg

SEQ ID NO: 177154 - DNA, 728 bp, Homo sapiens
  misc_feature: GYAE6OF01BCEY3.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcacggagtaaattgtgttgacacagtcctccacgccctacccttgttctttgtcctccgaaggggaacgcgcccaccctctccgtgcgagggccagtcagtagttgtacgcctaccttccgtagcctggtaaccaacgaacgaaaccgtcggaccacggtccctacccgacgtccctcctacacttcctcgttacggacttccggtacccttaaccgaaaccggaccggggtaccctaacgtcggtacctacccgtacccgaggtacccgttacgggttacgaggtccggacgtacggggttcgggtacgtacgggaactacgtaccttccgactccgtactaccggaatccgacgtcctaccgagtaaccggtcgttaggtacttttagtttacgtttacgtttagttacgtgtacgtaacgtcgttaagtacgtacgacgtaccgtaccgtcgtacccttaccgtcggttacggggacgtacgggtaacgagggtacgaacgtaccgtacgaaacggttcggtaggtacgtcgacaccctacttacgtttcgtaccttaccgttacgtcccttaccgtaccccg

SEQ ID NO: 177155 - DNA, 803 bp, Homo sapiens
  misc_feature: GYAE6OF01B7O1U.14.86.H09.1.454.CMB.1.raw
  modified_base (201)..(201): a, c, t, g, unknown or other
  misc_feature (201)..(201): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccagggaangcccaccctctcctgcgagggccagtcagagtgttacgcctacctccttacgcctaggtaacccaacacgaaacccgtcggaccaacggccctaccccgacgtacccctcccttccaacgtccttaccgtgtaacgtcgtaccctttacccgaaacgtaccggggaccctacggtcgggacctaccgtccccgagtcccgtaacggttccgaacggtcggtccgtaggggttcgggtaccggtagggaacctaccggttaacctttaccaccttcccgttacctaaccgtactacccgtacgtccctacccgtaaggtaccggtccggttacggttaagtttacgtttttaggtttaacgttttactttaaccgttcgttaacgtacgtaccgttaagttaacgtaacgtcgtacggtaccttaccgggtaccccgttaccccgttacggttttacccggggacgggttaaaccgggggtaaccggtaaacgggtcgggtaacggtaaccgttaccggaaacccgttaacgggtcgtacgggtccgtacgaccctaccgtaccgttcttaccgttacttaccgttcgttcccgttaaccccg

SEQ ID NO: 177156 - DNA, 760 bp, Homo sapiens
  misc_feature: GYAE6OF01AWTY8.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaangccaccctctcctgcagggccagtcagagtgttacgcctaccttccttagcctaggtaaccaaacgagaaaccctggaccagggcctcccacgccctcctcactcctctgatcgcctttacccaacgacgggcccacgtcggaccactcccgacgtccgtagggtttccggtaggccgtagggttcggggtccgtagggggtaacctaacggttacccttacctaccgttcctacccgaacctactacccgacgtacccttccccgtaaggacgtacccggttagggtaacgtttagtttttacggttaagtttttaacgttaacgtttcggttactaacggtcttaaacggtttaactacggtacgtaccgttccgttccggttaccccctacccggtttaccgggtttaccggggaccggggtaacggggtaacccggtaggggttacggaacgtaacgttacccggaaacggtaccgttgggtccggtacttcggaaccgtacctacgtttccgttacgttaccctttacgaccctttcccgtcccgtaacccg

SEQ ID NO: 177157 - DNA, 722 bp, Homo sapiens
  misc_feature: GYAE6OF01BJHMH.14.86.H09.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (514)..(514): a, c, t, g, unknown or other
  misc_feature (514)..(514): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgctccgaggggaancgccacctctcctgcagggccagtcagagtgttacgctacctcttagcctgtaccaanagaacctggccaggcctccagcctcncatctctgntcgcttccgaacgacggtccacgtggcacgtacccgacgcccgtagggttccaggtcggactagggtcgggtcgtagggactacggtaccttcgacgtccctaccacccgaattcccgtaacgtcccttaccccgtaagggaccgtcccgttaagggtacgtttaacgttttttaggtaacttttttaagttaccttcgtaaccgtatcgtaaggttanaacggtcaacggttccgtccgggtaccccttacccggttacggtttaccggggccgggtaaacggggtaccccgtaagggtccgggtaaacggtaccgttacccgaaaaccgggtaacgtttgggacccggttacgtacccgtaaccgtaacccgttagttaccccgtttaggttaccccgtttacaccgtttcccggttacccccgg

SEQ ID NO: 177158 - DNA, 669 bp, Homo sapiens
  misc_feature: GYAE6OF01A3EFG.14.86.H09.1.454.CMB.1.raw
  modified_base (204)..(204): a, c, t, g, unknown or other
  misc_feature (204)..(204): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagccaccttcttagcctggaccaacagaaacctggccaggcctcccagccctcctcatctctgatcgtccttccaacgtagggccacgtggacactcccagcctaggttcaggtcggcaggtcgggtctacggggacagtaccgttcaacttcgtaccaacctagtccacggtccctacccgtaggacgtcccgtagggtactttagttttacggttaagttttaagtttaccgttgttacgtagtacgttaagtaacgttagtactaacggtccgttacggtcccccttacccggtaaccggttttccgggacgggtaaccggggtaaccgtaacgggtgggaaacgtacgtacccgtaaacgtaacggtcggtaggtccgtacgaccctacctagttccttacggttaccttcgtacttcccgtaccccg

SEQ ID NO: 177159 - DNA, 1056 bp, Homo sapiens
  misc_feature: GYAE6OF01EGK5T.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctcggcctccagactatccgaccggagtaaatttggttagttagaccactacgttcctacccacgcccctacccgtttgttccttttcggtcccgtaccggaaagggggtaaacgccggtaccccctaccccttccgtccgtcggccgaccggggtcccaaggttcgaaggtacgttcggtttacgacccgtacccgttccgttacgcccgttacgggtaaacccaaacgtaaccggtaacccgtggaccccgtaacgggccctacccgtaaccgtccctttaccgaccgttaccttcgttaccttaggtaccgtttaccggtaccctttaacccgaaccgggtacccgggtaccctacggtacccgggtacccttaaccccgtacccccgtaacggggtaccccggttttaaggggtacccgtttaaggggtaccccgggttacggtttaaacccggggggtttcggggtaccggggtaacgggtttaaaacccggtacggtttaacccccttaccggttaaccccttttacccggaaacccgttaacctaccgggttaccccccgtaacggttacccccggtttaaccccggttaaccgggttacccggttaaccgggtttaaccgggtttaaccggtttttaaaggtttttaacggttttaacggtttttaacgtttaaccggtttaccgggttaacgttaacggtaacgttaacgtacggttaacggtacgtaccggttaccggtacccggttacccggttacccggttaccgggttaccggggtaccggggtaaccgggttaaccgggtacggtaacgggtaacggtaaccggtaaaccgtaaccggttaaggtccggttacggacggttcgaccgtaaccgtcgttaccgttacttaccttaccttccgtcccgttacccgg

SEQ ID NO: 177160 - DNA, 976 bp, Homo sapiens
  misc_feature: GYAE6OF01DM3DU.14.86.H09.1.454.CMB.1.raw
  modified_base (114)..(114): a, c, t, g, unknown or other
  misc_feature (114)..(114): n is a, c, g, or t
  modified_base (879)..(879): a, c, t, g, unknown or other
  misc_feature (879)..(879): n is a, c, g, or t
tcagcgtctagtaccacgaccggtgctcgatttagtgctatagacttgggttgggggagaactgctcagttaggacccagagggaccatggcagcccagctcagcttctcttcnctgctactctggcctccagtatactccgaaccgggaagtaaattcggttacgttagaaccaacgtacggttcctaccacggtccctacccgtttcggtttacctttttcggacccgttaaccggggaaaggggggaaaaccgccggtccccttaacccccgttcgttccccggtagggacccggaacggggttcccgtaaggttccgaaggttaggttaggtttaacccggccttaaccccttccggttacggacccgtttacgggtaaacccaacgaaccggtaaacccgttcgggaccgaacggtccctacccggactcccttactctaacttcctgttacgacgttaccgtaccctttaccgaaaccggtccggtacccgtaacggtcgtaacccgtacccgtaaccccggtacggtacccggttttaacgggtttccgggaaccggttcggggtaacggtacggggggtttacggggttacccggtaacggggtaaccgttaaacccgttcccggtttacctaccccggtttaccaccggaacccttacgtacccgtaacggttccctacggttaaccgggaccgtttccgggtaaaggtttcgttttaatttttaccgggttattttaaccgtgttaacgtaccgtagttaacccggttaagtcctacgggacttacgggtcccctaccggttttaccccgtaccggttacccgggggtttaggggaaacccgggttagggtaaacgggtacggggttanaacccgggttaaccgaccgggtaaacttaggttccggaaacgttctcgtacctaacgttccgttcgtttactcggtacctaacttccgggttaaccc

SEQ ID NO: 177161 - DNA, 782 bp, Homo sapiens
  misc_feature: GYAE6OF01DH3LR.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagtaaattgtgttgacacagtcctcacgccctaccctgtctttgtcgtccgaaggggaaagacgcccaccctctcctcgcgacgggccagtcgagtagtgttacgcctacctccgttacgacctacggtaacccaaacgaacggtaaacccgtcggaccgacggccctacccgacgccctacctctactcctacgtacgtacttcgaccttaccgaaccgacggccgtacgtcggacctacctcccgacgtacccgtaggttccgaggtacggcggtagggtcgggtcggtacgggactaacggtcctaccgtaccgtcctacgacctaacgtaccgaccgtacccgttacccgaggacgttaccgtagggtttactttaagtttttacggtttaactttacgtttacgttacggtacgtagtaacgttaaggttacacggtacgtaggttcccgtaccggtttacccccttacccggtttaccggggttaaccggggtaaccggggtaacggggtaaccggtacgggtaacgggtaaccgtacgtaaaccccggtaaacgttacggtcggttccgacgtcgacccgtactttaccgtcttaccgttacttaaccgtcccttcccggttacccc

SEQ ID NO: 177162 - DNA, 652 bp, Homo sapiens
  misc_feature: GYAE6OF01A8Z87.14.86.H09.1.454.CMB.1.raw
  modified_base (512)..(512): a, c, t, g, unknown or other
  misc_feature (512)..(512): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagcccacccttgttctttgtcctccgaaggggaagacgccaccctctcctgcgagggccagtcagagttgttacgcctaccttccttagccgttaggtaacccaaacgaacgaaaccgtcggaccacgggacctcccacgccctcctactactctcctagtactcgtaccttaccgaacggacgggacctacggtcggactactcccgagtcccgtaggtttcgacggtcggacgtagggtcgggtcgtacgggactacggtacttcactccgtactacacgtcacgtcctaccgtagacgtcgtggtattagttttagtatttacgtcgtgtacagtntaagtatacgctacgtcgtcgtacccttaccgtcgggttacgggacggaggaccgtagggtagacgtacgtaacgaacggttacgcggtaggctgaccctaacgtcgttacctcgttcttacctacgttcccgtaccccg

SEQ ID NO: 177163 - DNA, 788 bp, Homo sapiens
  misc_feature: GYAE6OF01AZZ1T.14.86.H09.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccgganaaattgtgttgacacagtctccagccacctgtctttgtctccgaggggaanagccacctctctgcagggccagtcagagtgtacgcactccccttagcctaggtaaccaacacgaaaccgtgaccaggcctcccagcctcctcatctctgatcgtcttccaacgcgggccaacgtcggacactccccgacgacccgtacgggtttaccacgggtcgggtaccgaaggttcgggggttacgtacgggggtaacctacggttacctttccaaccgtttcctaaccctaccctacgttccgtacgtaccccgttaccccgtaaggtaaccggttcccggtttaaggggtaaggttttacgttttttttaagggttaacgtttttaacgtttaccggtaggtttaccgaacgggtttcccgtaaaggtttacgtttaacggccgttaacgggtccgttaccgggaccccgttttaccccgtaacgggttttcccggggggaccggggtaacggggtaacccggtaggggttacgggtaacggaacccgttaccgggaaaaccgttacggttcggggtaccgcgttacgccgtaaaccgttctaccgttacgttccttacccgttcgttccccttaccccgg

SEQ ID NO: 177164 - DNA, 714 bp, Homo sapiens
  misc_feature: GYAE6OF01DJXZX.14.86.H09.1.454.CMB.1.raw
  modified_base (149)..(149): a, c, t, g, unknown or other
  misc_feature (149)..(149): n is a, c, g, or t
  modified_base (469)..(469): a, c, t, g, unknown or other
  misc_feature (469)..(469): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcacgganaaattgtgttgacacagtctccagccctaccctgttctttcgtctaccgaaggggaaacgcgtcccacctctcctgcgaggtccagtcagtagtgtacgctaccttctagcctaggtaaccaacgaacgtaaccgtcggaccaggtcctacccgcgtaccctcctcacttctcgtagacttcgaccttacccgaaacgcgggtccctaacgtcggacctacgttaccccgagtaccgtaggtacgaggttcggtacctagggtttcggggtacgtcggggtaacctaggttaccttaccgtaaccttcctcccgtaaccncgtacccgacgttaccctaccggtagaccgttccgtaggtaacttttacgtttttaggtacttttactacggttcgtaacgtcgtattaacgtagtaccagtaccgtcgttcgtacccttccggttcgttacgggaccgggacgtaacgtagggcgtaacgtactaaccggtaagacggttcggagtacctcggtacctaccgttacgttcgttacttaccgtttccgaccgtttcccgtacccg

SEQ ID NO: 177165 - DNA, 843 bp, Homo sapiens
  misc_feature: GYAE6OF01BM7AR.14.86.H09.1.454.CMB.1.raw
  modified_base (682)..(682): a, c, t, g, unknown or other
  misc_feature (682)..(682): n is a, c, g, or t
  modified_base (690)..(690): a, c, t, g, unknown or other
  misc_feature (690)..(690): n is a, c, g, or t
  modified_base (782)..(782): a, c, t, g, unknown or other
  misc_feature (782)..(782): n is a, c, g, or t
tcagcgtctagtaccacgaccggtgctcgatttagtgctatagacttgggtttgggggaggaactgctcagttaggacccagagggaaccatggcagcccagctcagcttctcttcctcctgtctactctggcctccagatatacgaccggaagtaaattgtgttacgaccacgtacgtcctaccacgcccctacccttgttcctttcgtccgtaccggaaggggaacacgcccctaccctcgtcctgaccgacgggcctaagtcgaagtacggttcgttacgacccttaacccttaccgttacggacccttacggaaacccaaaacgtaaccggtaaacccgttccgggaacccgaccgggtacccttacccgacgtcccttaccctaccgtacttcctacgttacgtacgtttccgtaccccttaaccggaaccggaccggggtaccctaaccggttaccggtacccctacgtaccccgtacggtacccggttaacgttacggacggtaccgggtcgggtaagggttccgggtacggtacggtaacgtacgtaccgttacctccgtacttccaaactacgtacccggaccttcccgtacgtaaggttccgacgggtttaaggttaactttttcgtttaggtttaattttaccgtacgttgtaaccggtatagggtttaanaccgtacncggtaaccgtcgtaccccggttctaacccggttcggggtaccggacgggtaacgtaccgttagggcaacggtacccgtaccaaaggttccgngtaggtacctgccctttaacggtacttcgttcccttaactttctccccggttacgtacccc

SEQ ID NO: 177166 - DNA, 775 bp, Homo sapiens
  misc_feature: GYAE6OF01CN0WS.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctcagccaccctgtctttgtctccgaggggaaacgacgcctaaccctcgtcctggccgacgggcccagttccgaaggtacgttgttaacgcctacccgttcctttaacgcccgttacgggtaaaccaaaacgaacggtaaaaaccccgtggaccccgagggaccccttaccccgaacggtcccttccctacaacttccctccgttagaacgtcgtaccttacccgaaacggaccggggtacccaacgttcggacctaccgttaccccgagtacccggtaggttacgaaggtcggacgtacgggttcgggtacgtcgggaactaggtaaccttcgtaacctctaccacgtactcaacgtcctacctaggtactcgtaggtacgtttattttcgtaagtttactcgttagtacgtagtacgttagtaacgttgacctaggtcggttacccggtacccttaccccggttacggtttaccgggggacgtaacggggtaaccgtaaggggttcgaaacggtaacctaccggaaacgttaggttacggcgttaccgttacggacctacgttacgttaccgttacgttcctttaccgccttttcccgtacccg

SEQ ID NO: 177167 - DNA, 698 bp, Homo sapiens
  misc_feature: GYAE6OF01DU4F3.14.86.H09.1.454.CMB.1.raw
  modified_base (522)..(522): a, c, t, g, unknown or other
  misc_feature (522)..(522): n is a, c, g, or t
tcagcgtctagtaccacgaccggtgctcgatttagtgctatagactttgggtttgggggaggaactgctcagttaggaccagagggaaccatggcagccccagctcagcttctcttcctcctgctactctggctccagatatcacggagtaaattgtgttgacacagtctccagccacctgttctttgtcctcgaaggggaagacgccaccctctcctgcgagggccagtcagagttgttacgcctacctccttagcctcggtaaccaacgaacgaaacctcggaccacggcctaccacgcctcctacactctctcgtactcgtacttaccgaacgacgggtcccacgtcggccacgtcccaacggtccgtacggttcagggtcgcgtagggttcggggtctgggaactaggtacctcactccacaaccactcacgtcctaccgtaggtaccgtccgttagggtaactttattttttacgggtaacttttaacttacggttgtactacgtacgtaagttacncggtacgacggtccgttacggtacccttaccgttacggggtccgggacgggtacggggtaacctagggtaggtaaccgtacgaaccgtaacgggtaacgttcgggtacggtcgttacgacccgtaacctacgtttaccgttcttaccgtttccgttacggtttccccgttaccccg

SEQ ID NO: 177168 - DNA, 820 bp, Homo sapiens
  misc_feature: GYAE6OF01DB6UG.14.86.H09.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagcccacccttgtctttgtctaccgaggggaaancgcccaccctctccgtgcgagggccagtcaagngttgttagcctacctccttagccctaggtaacccaacgaacgaaaccctggaccgaacggcctacccccgaagcccttacctccaacttcctctaggacttcgtaccttacccgaaacggaccgggtacccacggttcggacctaccgttaccccgaaggcccttaagggtttaccgaggttcggccggttaacgggttcgggggtacgtaacggggtactaacggtaccctttcctaaccctcccttaaccgaacccgttatacccgaccgttccgttaccccggtaaggtaaccgtaccggttagggtaacgtttttaacgttttttagggttaaacgtttttacgttaccgtttcgtaaccgtaacgggttactaaggtttacgtacggtaccgtacggtccgtcccggttaccccgttacccggtttaacgggtttcggggaaccgggtaaaccgggtaaccgttaaggggtccggaaacgttaaccggtacccgtaaaggtacggttcggtaccggacgttaccgacccgtaactacgttccgtacgtttccttaccgtctttcccggtaacccg

SEQ ID NO: 177169 - DNA, 718 bp, Homo sapiens
  misc_feature: GYAE6OF01EULX9.14.86.H09.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccacctgtctttgtctcaggggaangccaccctntcctgcagggccagtcagagtgttagccacctcttagcctggtaccaacagtaacctggccaggcctcccagcctcctcgatctctgactgccttaccgaacgngggcccagtgggacctacgtcccgagtccgtaaggttcaaggtcggactacgggttggggttcgtcggggaactacggtaccctttaccgaacttcccgtaccgaaccctatacccgacggtccccttaccccggtaacgtaccggtaccggtaggggttaaactttcgttttttaaggttaacgtttttactttaaccgtagtacggaacgtacgtaagttaactaaggtccgaagtccgtaccggccccgttacccgaacgttttccggggacggttaacgggacccgtaaaggggtcggaacgttaaccgtacccgtaaaacgtacccggttaggtaccgggtactcggacccttaaaccgtcgttcctcggtttaccctgtacccttccccggttaccccg

SEQ ID NO: 177170 - DNA, 612 bp, Homo sapiens
  misc_feature: GYAE6OF01EQQ68.14.86.H09.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctcaggggaaangccaccctntcctgcagggccagtcagagtgttagcacctcttagcctggtaccaanagaaacctggccaggcctcccagcctcctcactctctgatcgcttaccaacgngggcccacgtcggacactcccgacgcctaagggtttccaaggtggaccaggttcgggtcgtacgggacagtaccttcgacttccacaccatccacgtccctacccgtaagaccgtccgtaggtacgttagtttttagtaagttttattaccgtgtacgtagtacgtaaggttatagactagtccgttcggtcccttacccgtaacgtttccgggacggtagggaacccaagggttcgaacgtactaccgaaacgtacgtgtcggactcgaccacgtattctacgtctctctccgtacccg

SEQ ID NO: 177171 - DNA, 803 bp, Homo sapiens
  misc_feature: GYAE6OF01E3C0P.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcgacggtagaaattggttgttgacacagtcctccacgccctaccttgttctttcgtctaccgaaggggaaacgacgccctaccccttctccgtcgacgacgggaccaggtcaaggtgttagttacgacctaccttcgttacgaccttacggtaaccaaaccgacgtaaaccgtcggaccgtacgccctcccgacgtcccttcctctacttccgtctcgtactcgtccttaaccgaacggtaccggccacgtacggcctaacctacccgacgacccgtaggttccggtaaggtcggacggtacggttcggggtacgtacggggtaactaccggttaccgttcctaacgttacccgtacacccgtactccgtaaaccgtcccgtaccgtaggtaccgtaccggttaggttaacgttttttgtttttaacgggttagtttttacctacggtatccgtaaggtaccgttaaagtacgtacgaccgtccgggttactccccggtaacccttccgggtacggggtttacccgggacggttaacgggtacgggtaacgggccgtaaacggtacccgttaaacccgaaacggtggtttcgtaggggtacctaaccgccctaaacgtttcgttaccgttacttccctttacgtcccctcccgggttaccc

SEQ ID NO: 177172 - DNA, 818 bp, Homo sapiens
  misc_feature: GYAE6OF01AZOXE.14.86.H09.1.454.CMB.1.raw
  modified_base (150)..(150): a, c, t, g, unknown or other
  misc_feature (150)..(150): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccgganaaattgtgttgacacagtctccacgccctaccttgttctttgtctaccggaaggggaagacgcccaccctctccgtgcgacgggcagtcgaggtagttgtacgcctaccttccgttacgccgtacggtaaccaacgaacgtaaccgtcggaccgacggtccctccgaccgtacccttcctactacttcctacgtagtactccggtacccttaaccggaaccggaccgggaccctacggtccggaccctaccgtaccccgaaggtacccggttaaggtccggacgggtccgggtacgttacggggttcggggtaccgggtacggaactaccggtacctttaccctaccttcccgtaccaaaccgttacgtacccgtaaccgttaccccgtacccgtaacggtacccggtcggttaacgggttaagttttacggttttttaacggttttaagttttaaccgtttacgttacgttacggtaacggtacttaaaggttacgacggtaccgtaccggttcggtacccgttcccgttaacccggttcgggttaccgggacgggtaaccgggtaacggtacggtacggaacggtacgaaccggtaacgtacgggtcgtcggacgtacgacctaactacggttacttacgttacttactcccgttccggtaacccg

SEQ ID NO: 177173 - DNA, 1076 bp, Homo sapiens
  misc_feature: GYAE6OF01BJ7Q1.14.86.H09.1.454.CMB.1.raw
  modified_base (111)..(111): a, c, t, g, unknown or other
  misc_feature (111)..(111): n is a, c, g, or t
tcagcgtctagtaccacgaccggtgctcgatttagtgctatagacttgggtttgggggaggaactgctcgagttaggacccaggagggaaccagtggcagccccagctcgngcttctctcctcctgctacgtctggccctccgagtactactaccgaaccggtaagtaaagtttgtacggttacgaccaacgtacgttcctacccacgtccctaccgttgttcctttcgcgtaccggaagggaactccgccctacctcgtaccgtcgacgacgtctagtcgagtgttcgttacgcctaccgttacttcgaccgttacgaaacgtaacgtacggaaccgtcggaaccgtcgtcccgttacccggacgtaccctccgttacgtaccttcgttacgtaggtaaccgttccgtaccttaacccggaacggaccggttaacccgtaacggtccgtaaacccggttacccctaccccgggtaacgttaaccggttacgggtttacccgtaacgggttccggggaacgggttttaccggtttaacccgggggttacgggttaaaccccggaaacccgtttaacccccgggtttcccttaaaccgggttaccccctttacccgtaaaacccgggtttaactaaccccccggggtaacgggtttaccccgttaacccccgggttaaacccgggttaaccggttaacccgggttaccccggtttaaaggggttttaccggttttttaaaccggtttttaaaccgggtttttaaccgtttaaacccggtttaaacgtttaaccgggttaacccgttaaggtttaaaccggttttaaaccgttaccgggtaaccggttaaccggtaaccccgtttccgggtaaacccccggttttccccggtttaaccgggtaaccccgggttttaagggggaaccccggttaaaccgggttacgggtaaacccgggtacggttaaacccgggtaaccgttaccgtaaacgggttacggtaccggtaccgtaccggactttaccccgaagtttaccggtacaccgttttacccggcttaaccccggtaccgttacccg

SEQ ID NO: 177174 - DNA, 871 bp, Homo sapiens
  misc_feature: GYAE6OF01DQ6BE.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtcctccagccaccctgttctttgtctcgaaggggaaacgacgccaccctctcctgaccgacgggccagtcgaaggtagttagttacgcctaccgttccctttaacgcccgttacggtaacccaaacgtaacggtaaaacccgtcggaaccccgacgggccccttacccccgaacggtcccttaccgtccctaattccttcctagtactccgtacctttacccgaaaccggaccgggcccaacggtcggacctaactccccgaagtcccgtaacggttcgaggtcggcggtaggttcggggtccgtacgggactacggtaccttccaaccgttccgtaccaaccgtactacgaccggtcccttaacccgtaacggtacgtcccggttagggttaacgttttagtttttaagggtttaacgtttttaacttacggttcgttaacgaccggttagtaacgtttaacgtacgtacgtacggttaccgttaccggtcccctttacccggttaccggggttttacccggggaaccgggggtaccgggtaaccggggtttaccgggggtaaccggtaaccgtaaccggtaaaaccccgtaaaccgggtaacgttccggggtaacggttacccggtccgtaaacccggttacccttacgttaccggtttaccgttacgtttaccgttaaccccgttccgtttaaccccccgg

SEQ ID NO: 177175 - DNA, 1104 bp, Homo sapiens
  misc_feature: GYAE6OF01AMPAZ.14.86.H09.1.454.CMB.1.raw
  modified_base (401)..(401): a, c, t, g, unknown or other
  misc_feature (401)..(401): n is a, c, g, or t
tcagcgtctagtaccacgaccggtgctcgatttagtgctatagacttgggtttgggggaggaactgctcagttaggacccagagggaaccatggcagccccagctccagcttctcttcctcctgctactctggctcccagtatatcaccggagtaaattgtgttagacacgagttcctccacgccctacccgttgttcgttttcggaccttaccggaagggggaaacgtccgcccctaccccgttcttaccgtagccggacggggcccaaggttccgagggtaacgtttggttaacgcccgttaacccgttccgtttaacggccgttacggtaacccaaaacgacgtaaaccgtcggaccgtaacggccctacccgacgtcccttcctactaccttccgtntacgtacgtccgtaccttaaccgaacgacgggtccctaacgtccggtaactacgaccccggacgtacccgttaggttacacggtcggtacgtacgggttacgggtccggttaaggacctacggtacttaccgtaccttaccaacccgtaacctacgtacccgtaacggtaccccgtttaaccccggtaacggtacccggttacgtaaaccgggggtttaaacgtttttaacccggtttttttaacgggtttaaaccgttttttaaaccgggttttaaccgttcccgggttaaaacccgttttacggtaaaccggttttaaaaccggtaccggttttaacggaaaccccggttaaccgggtttccccggttaacccccggggttaaccccccgggttttaccccggtttaaaccccggggggttttaaccccggggggtttaaacccggggggaaaacccggggggtttaaaccccctttaaaagggggggtaacccggggttaaaaccgttacccccgttaaaaccggggtaaaacccggggtttaaaaacccttccggggggggtttaaacccttaccccggttaccggggttaaacccccgttaacccccgggtttaaaccgtttttcccgggttaaaacccgttttaaacccgttttaacccggttttccccccggtttaaacccccgggttaaaccggg

SEQ ID NO: 177176 - DNA, 884 bp, Homo sapiens
  misc_feature: GYAE6OF01AYSDL.14.86.H09.1.454.CMB.1.raw
  modified_base (146)..(146): a, c, t, g, unknown or other
  misc_feature (146)..(146): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggcctcccagattacnccaccggtagaaattcgtgttgaacacgtacgtcctaccgagtcccctacccgttcgtttcctttggtacccttcccggaaaggggggtaaactcccgaccccaacccccgttccgttcccgtcggaccgaccggggcctacggtacacggttagttagttaccgccttaccccgttacgttcgacccgttaggtaaaccaacgaaccgaaccgtccggacgtacggaccctcccgaccgtccttcctacgtaccttccgtactacggttctacctacccgtacgacccggcgtaacctccggaccgtaccgtacccgtacccgtacggaccccgttgtccgggtacggtaccgggtaccgacgggtttacggggaccggaccgggtttaaacaaccgggtttaccttaacggtacccctttccccaaccggttaaccctacgttacccgaccgttacccggtacccgttaacggtaccgttaccgttaaggttacgttttaccgtttagttttaaccgtttacgtttacctcgtacgtacttaccgtagttagtcccggtacttccggccgttccgttaccgttaccggtaccgttaccgggacggaacgggtacccgtagggtacctacggtaaccgtccgtaaaccggtcggtaccgggtcttacgtcccgtaccgttaaacccgtcgttaacccgttcggttaacctttcccgggtaccgttccccgtaaaccg

SEQ ID NO: 177177 - DNA, 960 bp, Homo sapiens
  misc_feature: GYAE6OF01EI7A1.14.86.H09.1.454.CMB.1.raw
  modified_base (663)..(663): a, c, t, g, unknown or other
  misc_feature (663)..(663): n is a, c, g, or t
tcagcgtctagtaccacgaccggtgctcgatttagtgctatagacttgggtttgggggaggaactgctcagttaggacccagagggaaccatggcagccccagctcagcttctcttccctctgtctactcgtgtcctcagatactccgaacggaagtaagttggttgttagacaacgtcgttcccacaccgcccctaccgttcgtttcgtttcggtacctacgggaaaggggaaacgacccgacccctcccttcctcggtcggacggtaccgggtacctacggtacgaaagggttacggtttacggtaccgtaacccctaccctttccgttaccggtaccgggttaaaccggaaccctaaacgaaaaccggttaaacccggtccggacccgtacgggtaccccctaaccgtccgtcccctcccttactccggtttccttacgttaggtacgtacccgttcccgtttaaacccggaaaccggggtccggtaccccgtaccgggttacggacccttaaccccgaaccccgtccgggttaaccgtttaacgggttaccgtacggggtaccggacgggttacgggggtttcgggggtaccggttaacggggaacgttacccggtttaaccgttcctaaccggttcccgtaactaccccggttaaacnccgttaccccgttacccgtaccgtaaaccgggtcccttaacggggttaggtttaaacgtttttagttttaagggttttaaccttttagtttacccgttgtaacgtactaaggtacgttaaccgagtaccgtacgttccggtccggttcccccttaccgggttaccggttacggggaccgggggtaacgtaacgggtagggtacggaccgttaccgaaccggtagtacgtcggggtacgcgttccgacctaacgtccttcggttaaccttcgttaccctacccgttcccgtaaccccg

SEQ ID NO: 177178 - DNA, 606 bp, Homo sapiens
  misc_feature: GYAE6OF01C23QP.14.86.H09.1.454.CMB.1.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (314)..(314): a, c, t, g, unknown or other
  misc_feature (314)..(314): n is a, c, g, or t
  modified_base (381)..(381): a, c, t, g, unknown or other
  misc_feature (381)..(381): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
tcagcgtctagtaccacgaccggtgctcgatttagtgctatagacttgggtttgggggaggaactgctcagttaggaccaggagggaaccatggcagcccagctcagcttctcttcctcctgctactctggctccagatatcgacggataaattgtgttacacacacgtctccagtcccaccttgtcctttagctacgaagggaacncgtcccaccctctccngacgtaggggaccagtcgagagttcgtacgctacctcgttagcgtacgaacactaagaaccgtgaccacggctccacgtcctcacattacncttagattcaccgtcaacgcggtactcgcggtacaactccgaacgtccgtaaggtcctaagtccggngtacggtgtacgtacggatacgtactctacnctacacctancgactctcgtacgacgtgtagtagttagtttagttacttacttgtagtacaaggtactagtacacgtactcgtcgtcgtaccgtacggttcggtacgggacggtacggtacgtacggtacgaacgtaacgacggtaacgagtcgtcgtactcgactactacgttctagttctactccgtcctac

SEQ ID NO: 177179 - DNA, 959 bp, Homo sapiens
  misc_feature: GYAE6OF01DUYGP.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctatctggctccgagatactcaccggagtaaattgtgttgacactagtcctccacgccctacccttgttctttcgtcctaccggaaggggaaacgaccgaccctacccctcttccgtcggacgacggggccgacgttccgaaggtacgttggttaccgcctacccttaccgttacggcccgttacggtaacccaaacgtaaccgtaaacccgttcggggacctaaccggtccccgtacccctaccggtcccttccctaccttacgttccgttaacttcggtaactttccgtacccttaaccggaaccggtaccggggacccttaacgggtcggtaccctaaaccgttcccccgaaaccggttccggttaacgggttaccggtagggttccgggtacggttacggggttacccgggggtacgtttacgggggaaactttaccggttaccttacccgttaacccgtccttaaccccgaccttaccgttacccgtaccggttaccccgttccggtaacggtccggttaccggttaaggttttaacgttttaacggtttttttacgggtttaacgttttttaaacttccggttacgggttaactaaccggtttaaccgaagttttaaccggtaaccggccgttaccgggttaccgtcccggttaccccgttaccggttaaccgggggttccgggacgggtaaacccggggtaacggtacgggtacggaaccgtaaccggtaaacccggttaaggttaccccggtgggttacccgtctaacccgggacttaccgtacggtttcttacccgttacttcccgttcccttccccggttaacccg

SEQ ID NO: 177180 - DNA, 773 bp, Homo sapiens
  misc_feature: GYAE6OF01BUGWS.14.86.H09.1.454.CMB.1.raw
  modified_base (211)..(211): a, c, t, g, unknown or other
  misc_feature (211)..(211): n is a, c, g, or t
  modified_base (709)..(709): a, c, t, g, unknown or other
  misc_feature (709)..(709): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggcctcccagatatcgaccggaataaattgtgttgacacgagtctccagcccacctgtctttgtcctaccgaaggggaaancgcccaccccttctccgtgcgaagggccagtcagagttgtacgcctaccgttctacgcctacgtaccaacacgaaaccgtcggccacggccctcccgtacgccctcctcatccgttctgactgtcccttaccgaacgacggtccacgtcggctacctcccgacgaccgtacggttacgacggtggaccgtaggggttcggtacgtacgggactaacggtaccttaccgtaccgtactaccaaccgtacgtccaacgtttcccgtacccgtttaaggacccgtcggtttaaggtagttttaaccttttaggttttaacgttttactttaacggtcgttaacgtcggtaaaccgtagttaaggaccgtagaaccgttcgtaacccggtccccttacccggttacgggtttcccggggaaggtaaccggggtaacgtaacggggtcgtaaaccggtacccggttaaaccaacgggtacggttcggtaaccgtccggttacnccccggttaagttaccttcccgggttactttcccgtttaccttacccggttcccgttaccccgg

SEQ ID NO: 177181 - DNA, 712 bp, Homo sapiens
  misc_feature: GYAE6OF01BAZQR.14.86.H09.1.454.CMB.1.raw
  modified_base (149)..(149): a, c, t, g, unknown or other
  misc_feature (149)..(149): n is a, c, g, or t
  modified_base (668)..(668): a, c, t, g, unknown or other
  misc_feature (668)..(668): n is a, c, g, or t
tcagcgtctagtaccacgaccggtgctcgatttagtgctatagacttgggtttgggggaggaactgctcagttaggacccagagggaaccatggcagcccagctcagcttctcttctcctgctactctggcctccagatatcaccgganaattgtgttacgacacagtctaccaagccaccgtgtctttgtctaccgagggaaacacgcctacctctctcgcgacggccagtcgagtagttgtacgcctaccgttcttagccgtaggaacctaacgacgtaaacccgtcggaccgacggtcctaccgtacgtccctacctctacgttccgtacgtacgtaacttcggaccctaccgtaacgaccggtacctaacgtccggacttacccgaccgtacggtaccgttaagggttacgacggaccgttaggtcgggtactacggggaactacggttaaccgtctaaccgtcctacgaacctgtacctacggtccttacccggagtaccgtacgttacggtacgttttacgttttacgtttaagtttaacgttacgttcgtacgtacgtagtaacgtataccggcttacgacgttccgtaacctccgttaggtccgggaacggtaacgaccgttaaggacgacgtaacgtaaccgacgtacgtggaccgtcncgtaactcgtaagttaccgttcacgttacaccgttcgcgttacg

SEQ ID NO: 177182 - DNA, 808 bp, Homo sapiens
  misc_feature: GYAE6OF01CSAGA.14.86.H09.1.454.CMB.1.raw
  modified_base (231)..(231): a, c, t, g, unknown or other
  misc_feature (231)..(231): n is a, c, g, or t
  modified_base (482)..(482): a, c, t, g, unknown or other
  misc_feature (482)..(482): n is a, c, g, or t
tcagcgtctagtaccacgaccggtgctcgatttagtgctatagacttgggtttgggggaggaactgctcagttaggacccagagggaaccatggcacgccccagctcagcttctcttcctcctgctactcgtggcctccgagatactccgaacggagtaaagttgtcgttacgaacacagtcctaccacgcccctacccttgttctttcgaccgtaccggaaggggaaacnccgtccccaccctcgtccgtgcgacggcctagtcaggtagttcgtacgcctacccttcgttacgccgtacggtaacccaagaccgtaaccgcgaccgaaggccctaacccgcgtccctccgtacctacttcctgtcgtacgtaccgttacccttaacccggaacgacccggtccctacgtccgacctaacccgtcccgacgtccggtaaggttcgaggtccggaggtcgggtcgggtacgtagggtaaccncggttcctactacccttaaccgcctaacgtctacgggtaacccctccgtaacggacggtaccgtacgggttaagttagttttaccgtttttaagttaccgtttaactcgttcggatacggtacgttatacgacgacttaccggtccgtaacccgttcccgttacgggaacgggttccgggaaccggggtaacgtacggttacggaacgggtaaccttaacccggagggtaaaacccgtcgggtcgggtaccctacggtacccgtacccgttattccggttttactaacccggtttcccttaaacggtccccgtttccccgggtacc

SEQ ID NO: 177183 - DNA, 769 bp, Homo sapiens
  misc_feature: GYAE6OF01A6XGP.14.86.H09.1.454.CMB.1.raw
  modified_base (153)..(153): a, c, t, g, unknown or other
  misc_feature (153)..(153): n is a, c, g, or t
  modified_base (168)..(168): a, c, t, g, unknown or other
  misc_feature (168)..(168): n is a, c, g, or t
  modified_base (751)..(751): a, c, t, g, unknown or other
  misc_feature (751)..(751): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggcctcccagatatcaccggganaaattgtgttgacanagtctcagccacctgtactttgtctaccgaggggaacacgcctacccgtctcccgtaggccgaggggccctagtccgaaggtaggttcgttaacgccctaacccttccgtttaacgcccgtttagggaaaccccaaacgaacggtaaaacccgttcgggacccgtaaccgggtcccttaccccgaacggtcccctttaccttacggtaacttccggttacctcgggtacttccggtacctttacccgaaaccggacgggggacccctaacgttcgggacctaccgtaccccgaggtacccgtaaggtttccaagggtcggtccgagggttcggggtactacggggactacggtaccttcaaccgttccgtacccgacctagttccgaccgtaccttacccggtaagaccggtccgttaagggtaactttaagtttttaccgttaagtttactttacctgtaccgtaagtcgtaagttgacgtactacggcgtacgccgtaccgtagttccgggacgacgtacggagtcgactagacccgaaagtagtggtggactcggaacccgtaatcgttactcgtttaancggttacctcccggttcc

SEQ ID NO: 177184 - DNA, 814 bp, Homo sapiens
  misc_feature: GYAE6OF01AUUBH.14.86.H09.1.454.CMB.1.raw
  modified_base (137)..(137): a, c, t, g, unknown or other
  misc_feature (137)..(137): n is a, c, g, or t
  modified_base (212)..(212): a, c, t, g, unknown or other
  misc_feature (212)..(212): n is a, c, g, or t
tcagcgtctagtaccacgaccggtgctcgatttagtgctatagacttgggtttgggggaggaactgctcagttaggaccagaggaaccatggcagccccagctcagcttctcttcctcctgctactctggctccagntactcgacggagtaaattgtgttacgacacacgtctccagccctaccctgttctttcgccgtacgaaggggaacncgtaccctaccgtccgtaccgtgaccgtacgggacctaggtcgaaggtacgtttacgttaaccgcccgttacccgttccgtttaacgggccctttaacgggaaaaccctaaacgtaaccggtaaaacccgtcggtaccgaaccggtccctacccggactaccctttcccgaaccgtcgttccccgtacgtacggttaccgtacgttaaccccgtttaccgaaccggtccggggtaccccttacggtaaccggtaccctacccggtacccgacgggttacccgttacgggtaccgtaaggtccggaccggtttacggggttaccggtaacgggtaccggtacggtaacccgttaccgttacccggtaaccttccgtacccgtaacgtactccgtaaccgttcccgtacgtaacggtaccgtacggttacggttacgttttaacgtttaggttaacgtttatacgtgtacgtagtctaagtgacgtctagtccgcgtccctcgtacggtcggacgtacggtagacggtgaacctagccgtaaacgtcgtacgcggtactaccgccgtaattccgtacgttcaccggttctaccgtccgttaccg

SEQ ID NO: 177185 - DNA, 828 bp, Homo sapiens
  misc_feature: GYAE6OF01CQID3.14.86.H09.1.454.CMB.1.raw
  modified_base (213)..(213): a, c, t, g, unknown or other
  misc_feature (213)..(213): n is a, c, g, or t
tcagcgtctagtaccacgaccggtgctcgatttagtgctatagacttgggtttgggggaggaactgctcagttaggcccagagggaaccatggcagccccagctcagcttctcttcctcctgctactctcggcctaccagatatcaccggagaaattgtgttacgacactagtcctccacgtcccacctgttctttcgcctacgaggggaacncgcctaccctctccgtcgacgacggcacgtcgagtacgttgtacgcctaccgttccttacgccgtaggtaaccaacgaacgtaacccgtcgggacccacggtccctacccgtacgtcccttacccgtactactcctacgtacgtacgtccgttcctaccgaaacggccggtacccgtacgtacggcttaaccgtccgacgtaccgtacggtcgaggtcgcggtacgggttcgggtacgttacgggacttaacgtaccctacgtacccttacgtaccgaccttacctacgtacccgtccttaaccggacgtcggtaccggttaaggttacgtttaggttttttaaacgttacgttttacgtaccgtacgggttaccagttaaccggtatacggtacgtacggtaccgttcttcccggtacccgtttacccggttcggggtaccgggtaacgggtacgtaacccgggtaggggttacccaaaggtttccccgggaaaaccgtcggttaacgggttccgggtaaccttaacccggacccgtttaccccgttaagttcccggtttaaccctttcccgttaaaccctttccgggtaaccccctttcccgttaaacccggg

SEQ ID NO: 177186 - DNA, 172 bp, Homo sapiens
  misc_feature: GYAE6OF02HI244.14.86.H09.1.454.CMB.1.raw
  modified_base (171)..(172): a, c, t, g, unknown or other
  misc_feature (171)..(172): n is a, c, g, or t
tcagcgtctagtaccacgaccggtgctcgatttagtgctatagacttgggtttggggaagaggaagactgacggtccccaggagttcaggtgctgggcacagcggccctgggctgcctggtcaaggactacttccgtactagacgctgagcgggctggcaaggcgcatagnn

SEQ ID NO: 177187 - DNA, 600 bp, Homo sapiens
  misc_feature: GYAE6OF02H7SUF.14.86.H09.1.454.CMB.1.raw
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
tcagcgtctagtaccacgaccggtgctcgatttagtgctatagacttggggtttagggggacggaactgctcacgttaggacccagagggaacccatggcagccccagctcaggccttctccttcctcctgcctacttcgtggctcccagatactcaccgggagaaacttgtcgttgaccacagtctccagccaccctggtctttgctccaggggaaancgtccgaccctctccgtgactacgggccagtccagtgtggttaanccaccttccttaggccttggtaaccaacagtaaaccgtggccaggctcccgacgcctactcatctctgatgcttccaacnggccactggcatcccagaccaggttcagtggacnggtggctgggacagacttcnctctcgaccatcacgctccaagcncctgganattttgagtttntactgtacngtcagtactagnaagtctggacccttccacgttttcgggccgtaggggacccaaagggtggtaacgattaccccgaaaggtaccgtggttacggccttcggaccacccgtaatcccgttaggttacctttcgacgttcccgttaccccgg

SEQ ID NO: 177188 - DNA, 512 bp, Homo sapiens
  misc_feature: GYAE6OF02GQJ08.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagacgcctggagtattttgtagtttattactgtcagcagtatagcagctggcctcccacgtttcggcggtacgggaccaaggtggagactaccaacgacgtgtcggctgcacatctgtctcatctcccg

SEQ ID NO: 177189 - DNA, 497 bp, Homo sapiens
  misc_feature: GYAE6OF02INEJW.14.86.H09.1.454.CMB.1.raw
  modified_base (202)..(202): a, c, t, g, unknown or other
  misc_feature (202)..(202): n is a, c, g, or t
tcagcgtctagtaccacgaccggtgctcgatttagtgctatagacttgggtttggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaacagaaacctggccaggctcccagcctcctcatctctgatgcttcaacaggccactggcatcccagccaggttcagtggcagtggtctgggacagacttcactctcaccatcagctccctagacgcctggatattttgtagtttattactgtcagcagtatagcagctgcctccactttcggcgtagggaccaaggtggagatccgaagacgtgtggctgcacatctgtctcatctccg

SEQ ID NO: 177190 - DNA, 179 bp, Homo sapiens
  misc_feature: GYAE6OF02GAYNN.14.86.H09.1.454.CMB.1.raw
  modified_base (173)..(179): a, c, t, g, unknown or other
  misc_feature (173)..(179): n is a, c, g, or t
tcagcgtctagtaccacgaccggtgctcgatttagtgctatagacttgggtttgggggaagaggaagactgacggtcccccaggagttcaggtgctgggcacagcggccctgggctgcctggtcaaggactacttccgtactagacgctgagcgggctggcaaggcgcatagnnnnnnn

SEQ ID NO: 177191 - DNA, 567 bp, Homo sapiens
  misc_feature: GYAE6OF02IZSH4.14.86.H09.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctntcctgcagggccagtcagagtgtagcacctccttagcctggtaccaacagaaacctggccaggctccagcctcctcatctctgatgcttccaacaggccactggcatcccagccaggttcagtgcagtggtctggacagacttnactctcaccatcagcctccctagacgccgtgacgtattttgagtttatactgttcagtctagttanagcaggctcggcctcccacgtttcggcggtaagggaccctaaagggtcggaagacgttacccgaaacggtaaccgttcggtacggcttacggaccgaacccgtaagttccgtaggttccctttacacgttcccgtttaccccgg

SEQ ID NO: 177192 - DNA, 173 bp, Homo sapiens; identical to SEQ ID NO: 177079
  misc_feature: GYAE6OF02F38T0.14.86.H09.1.454.CMB.1.raw
  modified_base (173)..(173): a, c, t, g, unknown or other
  misc_feature (173)..(173): n is a, c, g, or t

SEQ ID NO: 177193 - DNA, 526 bp, Homo sapiens
  misc_feature: GYAE6OF02H0G3A.14.86.H09.1.454.CMB.1.raw
  modified_base (382)..(382): a, c, t, g, unknown or other
  misc_feature (382)..(382): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctcttagcctggtaccaacagaaacctggccaggctcccagcctcctcatctctgatgcttcaacagggccactggcatcccagccaggtcagtggcagtgggtctgggacagacttcactctcaccatcagctcccagngcctggagtattttgtagtttattactgtcagcagtatagcagctggcctccctatttcggcgtagggaccaaggtggagataccgaacgtaacgtggttcggctgaccaccgtatccgtgttccttacacttccgttaccccg

SEQ ID NO: 177194 - DNA, 581 bp, Homo sapiens
  misc_feature: GYAE6OF02FSEXB.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctggggacagacttcactctcaccatcagcctccctagacgcctggacgtattttgtagtttattactgtcagctagtatagcagctggcccttcccacgtttcgggacggtagggaccaaagggtgggaacgacgttacccgaaacggtaaccgttggtacgggtccgttaggccctaacccgtaacttccgttaggttcccttttacgtacctttccctttaccccccgg

SEQ ID NO: 177195 - DNA, 562 bp, Homo sapiens
  misc_feature: GYAE6OF02GNJDW.14.86.H09.1.454.CMB.1.raw
  modified_base (205)..(205): a, c, t, g, unknown or other
  misc_feature (205)..(205): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgagggggaaanagcccaccctctcctgcagggccagtcagagtgtagcacctcttagcctggtaccaacagaaacctggccaggcctcccagccctcctcatcctctgatgccttaccaacgcgggccacgtggccactccccagccaggttcaggtcggcaggtggtctgggacagtcttcactctcaccatcagtcctcctagacgccgtggagttattttgttagtttattacgtgtctagtctagttatagcagcgtcggcccttcccgtacgtttcgggcggtacggaccgaggtggagactaccgaacgtacgtggtacggtcgtcgacaccgtacttcgtcgttcttctacttccttcccg

SEQ ID NO: 177196 - DNA, 527 bp, Homo sapiens
  misc_feature: GYAE6OF02GAF3M.14.86.H09.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctcttagcctggtaccaacagaaacctggccaggctcccagcctcctcatctctgatgcttccaacngggccactggcatcccagccaggttcagtggcagtgggtctgggacagacttcactctcaccatcagcctccctagacgcctggagtattttgtagtttattactgtcagcagtatagcagctggccctcccacgtttcggcggtacgggaccaagggtggagactaccgaacgacgtggtcggctcgaccaccgatccgtgtcttctactccttcccg

SEQ ID NO: 177197 - DNA, 510 bp, Homo sapiens
  misc_feature: GYAE6OF02JJ7S4.14.86.H09.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaacagaaacctggccaggctcccagcctcctcatctctgatgcttccaacngggccactggcatcccagccaggttcagtggcagtgggtctgggacagacttcactctcaccatcagcctccctagacgcctggagtatttgtagtttatactgtcagctagtatagcagtctggcctccgacgtttcggacggaggaccaggtgagactaccgaacgacgtggtcgctgcacgatctgtcttcatccttc

SEQ ID NO: 177198 - DNA, 512 bp, Homo sapiens
  misc_feature: GYAE6OF02HOHJB.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctcttagcctggtaccaacagaaacctggccaggctcccagcctctcatctctgatgcttccaacagggccactggcatcccagccaggttcagtggcagtgggtctgggacagactcactctcaccatcagctcctagacgcctggacgtattttgtagtttattactgttcagtcagtatagcagctggccttcccacgtttcggcggtagggaccgaaggtggagataccgaacgtacgtggtgctgcacatctgtctcatctcccg

SEQ ID NO: 177199 - DNA, 569 bp, Homo sapiens
  misc_feature: GYAE6OF02GS78H.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctccttagcctggtaccaacagaaacctggccaggctcccagcctcctcatctctgatgcttccaacagggccactggcatcccagccaggttcagtggcagtggtctgggacagcttcactctcaccatcagcctccctagacgtcctggacgtattttgtagtttatactgtacagctagtatagctagctcggccttcccgacgtttcgggacggagggacccgaaagggtcggagtacttacccgaacggtaacgttggtacgggaccttcggaccctaccgacttccgttccggttcctttacgtaccttcccgttaccccg

SEQ ID NO: 177200 - DNA, 559 bp, Homo sapiens
  misc_feature: GYAE6OF02I3I9A.14.86.H09.1.454.CMB.1.raw
  modified_base (370)..(370): a, c, t, g, unknown or other
  misc_feature (370)..(370): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccacctctcctgcagggccagtcagagtgttagcacctccttagcctggtaccaacagaacctggccaggctcccagcctcctcatctctgatgccttccaacgagggcccactggcactcccagccaggttcagtgcaggtgggtctgggacagacttcactcncaccatcagtcctccctagacgtcctggtagtattttgtagtttattactgtcagtcagttatagcagtcgtggtccctccgtacgtttcgggcgggtacggtaccgaaggtggaagtaccgtaccgaacgtaacgtggtacggcgtacgcaccgtacttcgttagtccgttctaccgttccgtacccg

SEQ ID NO: 177201 - DNA, 511 bp, Homo sapiens
  misc_feature: GYAE6OF02GD88E.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctcctagacgcctggatattttgtagtttattactgtcagctagtatagcagctggccctccactttcggcggtacgggaccaaggtgagataccgaacgacgtggtggctgcacatctgtctctactctcccg

SEQ ID NO: 177202 - DNA, 569 bp, Homo sapiens
  misc_feature: GYAE6OF02GV6N5.14.86.H09.1.454.CMB.1.raw
  modified_base (204)..(204): a, c, t, g, unknown or other
  misc_feature (204)..(204): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaangccaccctctcctgcagggccagtcagagtgttagcacctcttagcctggtaccaacagaaacctggccaggctcccagcctcctcatctctgatgcttccaacagggccactggcatcccagccaggttcagtggcagtgggtctgggacagacttcactctcaccatcagcctccagacgcctggagtattttgtagtttattactgtcagcagtatagcagcgtcgcccttccctacgtttccgggacgggtacgggacccgtaagggtggacgtacgtaccgaaacggaacgttggtacgggtctacggacctaaccgtacttcgttacggttcctttacgtacctttcccgttacccccg

SEQ ID NO: 177203 - DNA, 598 bp, Homo sapiens
  misc_feature: GYAE6OF02H4A0K.14.86.H09.1.454.CMB.1.raw
  modified_base (149)..(149): a, c, t, g, unknown or other
  misc_feature (149)..(149): n is a, c, g, or t
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
tcagcgtctagtaccacgaccggtgctcgatttagtgctatagacttgggtttgggggaggaactgctcagttaggaccagagggaaccatggcagccccagctcagcttctcttcctcctgctactctggctccagatatcaccgganaaattgtgttgacacagtctccagccaccctgtctttgtctccgaaggggaaangccaccctctcctgcagggccagtcagagtgttagcacctcttagcctggtacaacagaacctggccaggctcccagcctctcatctactgactgcttccaanacgggccactggcactcccagcctagttcagtggcaggtgggtntgggactagacttcacttctacaccgatcagtcctcctagacgtccgtaggagtttacttttagtaagtttattacttgttccagtcagttaactgactagacttcgggcccttcccgtaacggtttccgggacggggtaacgaccggtaaagggtaggacgtacgtacccgaaacggtacgtggtacggtacctaggacctaaccgtacgttcgttcgtttcctttacaccgtttcccttaccccgg

SEQ ID NO: 177204 - DNA, 514 bp, Homo sapiens
  misc_feature: GYAE6OF02FYJ3Y.14.86.H09.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctntcctgcagggccagtcagagtgttagcacctccttagccctggtaccaacagaaacctggccaggctcccagccctcctcatctctgatgcttccaacagggccactggcatcccagccaggttcagtggcagtgggtctgggacagacttcactctcaccatcagcctcctagagccgtggagtatttgtagtttatacgtgtcagcagtanagcagctcgcctccacgtttcggcggaggaccaaggtgagactacgaacgaacgtggtcgctgcactntcgtgtcttcactccttcccg

SEQ ID NO: 177205 - DNA, 611 bp, Homo sapiens
  misc_feature: GYAE6OF02HMZUM.14.86.H09.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtactccaggggaaanagccaccctctcctgcagggccagtcagagtgttagcacctccttagcctggtaccaanagaaacctggccaggctcccaggcctcctcatgtatgatgcactcccagacgggcccaccggcactcccagccaggttcagtggcaggcgggtctgggacagacttcactctcaccatcagcagcctagacgtctagtaagtattttagcttaagttttattacttgtacagtcgaggcggggactaagttcggccgtcgtccgtaccggtttccggggaccggggggtaaccgtaagggtacgggtacggttaccgaaaccggtaacggttcggtacggccgttcggaccgtaccgtaacgttccgttacggttcctttaccgtacctttcccgttccccgtacccg

SEQ ID NO: 177206 - DNA, 615 bp, Homo sapiens
  misc_feature: GYAE6OF02I75UV.14.86.H09.1.454.CMB.1.raw
  modified_base (203)..(203): a, c, t, g, unknown or other
  misc_feature (203)..(203): n is a, c, g, or t
  modified_base (383)..(383): a, c, t, g, unknown or other
  misc_feature (383)..(383): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaacagaaacctggccaggcctcccagccctcctcatctctgatcgccttccaacgacgggcccacgtcggcactcccgagcctaggttcaggtggctaggtgggtctgggacagtacttcactcncaccatcagctacccgtagacgcgtaggatattttgagtttatacgtgtcagtcagtatagctagtcgttcggacccttcccgtacgtttccggggaccgggtaacgggtaacccgtaaggggtcgggaacgtaccgtacccgaaacggtaaccgttgggtacggtaccttacggaccctaacccgtacgttcgttacggtttaccctactaccgtttccccgttacccccg

SEQ ID NO: 177207 - DNA, 589 bp, Homo sapiens
  misc_feature: GYAE6OF02G2KEW.14.86.H09.1.454.CMB.1.raw
  modified_base (446)..(446): a, c, t, g, unknown or other
  misc_feature (446)..(446): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgtagcacctccttagcctggtaccaacagaaacctggccaggctcccagccctcctcatcctctgatgccttccaacacgggccacgtggccactcccgagcctaggttcagtcggctaggtgggtctggggacagtcttcactctcaccatcacgtcctcccgtagcgtcctagggattattttgtagtttatacgtgtcagtctagttanagcagtctcggtccctcccgtacgtttccgggacggtacgggaccgtaaggtcgggactacgtaccgaaacggtacgttcgggtcggaccgtcggacctaccgtacttccgttcgttacctttccacgtttcccctaccccgg

SEQ ID NO: 177208 - DNA, 664 bp, Homo sapiens
  misc_feature: GYAE6OF02INSGV.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccaccctctcctgcagggccagtcagagtgttagcacctccttagcctggtaccaacagaaacctggaccaggcctccagcctcctcatctctgatcgccttaccaacgacggggcccacgtcgggaccaccttcccgaagtcccgtagggtttcagggtcggaccgtaaggggttcggggtactacgggggaactacggtaacctttcgaaccttctaccgaacctatccgacgtccttacccgtagacggtccgtagggtaacgttatttttgtaagtttacttagtcgttactagctaagttagtcgacgtagtccgttacggccccttaccgtacggtttcgggaaccggtacgggaaccgtaaggggtagacgtaacctcccgggaaacgtacgttcgggacggtactacggtaccacgtgtaccttcgtaccgtttacacgttcccttacccg

SEQ ID NO: 177209 - DNA, 175 bp, Homo sapiens
  misc_feature: GYAE6OF02G8F6V.14.86.H09.1.454.CMB.1.raw
  modified_base (174)..(175): a, c, t, g, unknown or other
  misc_feature (174)..(175): n is a, c, g, or t
tcagcgtctagtaccacgaccggtgctcgatttagtgctatagacttgggtttgggggaagaggaagactgacggtccccccaggagttcaggtgctgggcacagcggccctgggctgcctggtcaaggactacttccgtactagacgctgagcgggctggcaaggcgcatagnn

SEQ ID NO: 177210 - DNA, 596 bp, Homo sapiens
  misc_feature: GYAE6OF02JP4SL.14.86.H09.1.454.CMB.1.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
  modified_base (376)..(376): a, c, t, g, unknown or other
  misc_feature (376)..(376): n is a, c, g, or t
tcagcgtctagtaccacgaccggtgctcgatttagtgctatagacttgggtttgggggaggaactgctcagttaggacccagagggaaccatggcagccccaggctcagcttctcttcctcctgtcgttacgtctggctcccagatacttaccggagtaattgtgttgacacagtctccagccacctgtctttgctcaggggaancgccacctctcctgcagggccagtcagagtgttagcacctcttagcctggtaccaacngaaacctggccaggctcccagccctctcatctcgtgatcgcttccaacgcggccacgtggcatccccagccaggttcaggtgcaggtggtctgggacagacttcactctcacntcacgtctccgtagacgtccgtaggtacgttatttttggtaaacttttcttactggttacaagtctaaggttactagcctaggtcctggtccctcccgtacgtttcgggacgggtaaccgggtacctaaggggtcgaacgtacgtacccgtaacgtcgtaggtcggtacctggaacccaacttgttccgtcggttcttaacctcgttccgttcccgtacc

SEQ ID NO: 177211 - DNA, 564 bp, Homo sapiens
  misc_feature: GYAE6OF02FRX7S.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccacctctcctgcagggccagtcagagtgttagcacctccttagcctggtaccaacagaaacctggccaggctcccagcctcctcatctctgatcgcttccaacagggccacgtggcatcccagcctaggttcagtggcaggtgggtctgggacagtacttcactctcaccatcacgcctccctagacgcctggagttattttgtagtttattactgttcagctagtatagcagctcggcctcccgtacgtttcgggacggtacgggacctaagggtcggacgactaccgaacgaacgttggtacggcctacggcctaaccgtacgttccttggttacctttcgtacttcccttaccccg

SEQ ID NO: 177212 - DNA, 785 bp, Homo sapiens
  misc_feature: GYAE6OF02I1GIX.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggagggaactgctcagttaggacccagagggaaccatggcagccccagctcagcgttctcttcctcctgctactctggctcccagatatcaccggagaaattgtgttgacacagtctccagccacctgtctttgctccgaggggaanagcccacctctccgtgcaggccagtcagagtgttagcaccttccttagcctggtaaccaactacgaaacctcggaccaggcctcccgacgccctcctcacttcctctgactcgaccttacccaaacgacgggccctaacgtcggaccctaacgtccccgacggaccccgtaagggtttcaacggttcggacgtacgggtcgggggttccgtagggggaactacggtaacttttccgaccgtttacctccctaaaccctacgttaccaaccggtccctttaaccccgtaaaggcccggtcccgttaagggtaccggtttagttttttacgttaaacggttttatttaaccgtcgttaacgaacgtgttaaggttaactaacgggctacggtaccgttccggtaccccttaccccgttaacgggtttcccggggaccgggtaaacgggaaccccggtaaagggtccggggtaaacgtacccgtaaccgttaaaccggacggtttcgggtaccggtacgttaccggaccttaacccggtaggttccctttaaggttccctttactacccgttcccgttacccccg

SEQ ID NO: 177213 - DNA, 688 bp, Homo sapiens
  misc_feature: GYAE6OF02HMMEA.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaacagaaacctggccaggctcccagcctcctcatctctgatgcttccaacacgggccactggcactcccagccaggttcaggtggcgtaggtgggtcgtgggacagtacttcactcctaccacctatccgacgtccctacccgtaggaccgtccgttagggacgtttagtttttaggtttaagttttaactttacgttacggttaccgtaagtacgtaaggttactacgtctaacggtcgtaccggtccccttaccccgttaccggttttccggggaccggggtaaccgggtaaccggtaagggtacgggtaacgtaccgtacccgtaaaccggttaacggtcgggtacgggttaccgtacggaacccgtaaccgttacgttacccgttcgtttacccgtttaccgttaccgtttccccgttacccccgg

SEQ ID NO: 177214 - DNA, 588 bp, Homo sapiens
  misc_feature: GYAE6OF02FF8RC.14.86.H09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccacctctcctgcagggccagtcagagtgttagcacctcttagccctggtaccaanagaaacctggccaggctcccagcctcctcatctctgatgcttccaacnggccactggcatcccagcccaggttcagtggcgtaggtgggtctagggacagtacttcactctacacatcgacgtcctaccgtagaccgtcgtgggtacttagttttcgttaagttttactacgtgtactagacgtagtactagctagtcgtcgcccttcccgtacgtttccgggacgggtaacgggaaccgtaagggtcggaagtaccgtaccgaaacgtaggtggtcggtactcggacctaacgtcgttcgttcgttacttctacttcccgtaccccg

SEQ ID NO: 177215 - DNA, 596 bp, Homo sapiens
  misc_feature: GYAE6OF02F0U3O.14.86.H09.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaangccacctntcctgcagggccagtcagagtgttagcacctccttagcctggtaccaanagaaacctggcaggctccagcctctcatctctgatgcttccaacnggccatggcatcccagccaggttcaggtcgcaggtggtctgggacagacttcactctcacntcagtcctccctagacgtccgtaggtacgttattttcggtaagtttacttacgtcggttactaagtacgttaaggtttataacggtctaggtccgttcggtacccttcccgtaacgtttcgggaccgggtagggaaccctagggtcggaacgtacctaccgaacgtacgttcggtacggctcggacctaaccgtacgttccttcgttaccttcgtacttcccgttaccccg

SEQ ID NO: 177216 - DNA, 591 bp, Homo sapiens
  misc_feature: GYAE6OF02IPJZI.14.86.H09.1.454.CMB.1.raw
  modified_base (233)..(233): a, c, t, g, unknown or other
  misc_feature (233)..(233): n is a, c, g, or t
  modified_base (394)..(394): a, c, t, g, unknown or other
  misc_feature (394)..(394): n is a, c, g, or t
tcagcgtctagtaccacgaccggtgctcgatttagtgctatagacttgggtttggggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagngtgttagcacctccttagcctggtaccaacagaaacctggccaggctccccagcctcctcatctctgatgctttccaacacgggccactggcactcccagccaggttcagtggcaggtggtctgggacagacttcactctacaccatcagcctccctaganccgtggagtattttgtagtttattactgttacagtacagttatagcagtctcggtccttccctacgtttcgggaccggtacgggaaccgtaagggtcgggaagtacgtacccgtaaacggaaccgttggtacggtcgtaggacccaacccgtattccgttcggttaccctttacgtactttacccgtttaccccccg

SEQ ID NO: 177217 - DNA, 575 bp, Homo sapiens
  misc_feature: GYAE6OF02GNI6I.14.86.H09.1.454.CMB.1.raw
  modified_base (206)..(206): a, c, t, g, unknown or other
  misc_feature (206)..(206): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (541)..(541): a, c, t, g, unknown or other
  misc_feature (541)..(541): n is a, c, g, or t
tcagcgtctagtaccacgaccggtgctcgatttagtgctatagacttagggtttgggggaggaactgctcagttaggaccccagagggaaccatggcagccccagctcgagcttctcttcctcctgctactctggctcccagatatcaccggagaaattgtgttgacacagtctccagccaccctgtctttgtctccaggggaaanagccaccctctcctgcagggccagtcagagtgttacgcacctccttagcctaggtaccaacagaaacctggaccaggcctcccagccctcctnactctctgatcgcttaccaacgacgggccactggccacgtcccagcctaggtcaggtcggcaggtggtcngggactagacttcactcncaccatcagtcctccgtagctaccgtggtagttattttagttatttattctgtacagctaagtatagctagcgtcggtaccctcccgtagtttccgggacgggtacggaacggaggtggacgtacaccgaacggtacgttggacgtctcgaccnccttagtcttactcttacctacgtcccgtacccg

SEQ ID NO: 177218 - DNA, 542 bp, Homo sapiens
  misc_feature: GYAE6OF02HU9PJ.14.86.H09.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagngccaccctctcctgcagggccagtcagagtgttagcacctcttagcctggtaccaanagaaacctggccaggctcccagcctcctcatctctgatgcttccaacagggccacgtggcactcccagccaggttcagtggcaggtgggtctgggacagacttcactctcaccatcagcctcctagacgcctggagtattttgtagtttattactgtcagctagtatagctagctgcctccacgtttcggcggaggtaccgaggtggagactaccgaacgtaacgtggtacggctacgccacctattccgttacggttcctttacactttccctaccccgg

SEQ ID NO: 177219 - DNA, 581 bp, Homo sapiens
  misc_feature: GYAE6OF02G26SZ.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggcctcccagccctcctcatctctgatgccttccaacgacgggccacgtggcactcccagcctaggttcaggtcggcaggtgggtctgggacagacttcactctcacatcagtcctcctagacgccgtggagttattttgttagtttacgttacttcgtacagtctagtatagcagtcgtcggcccttccgtacgtttccggacgggtacgggtaaccgtaagggtcggagacgtaccgaacggtacgtggtacggtcgtcgaccgtacgtacgttcgtcgtaccttcgtacgttcccgttacccg

SEQ ID NO: 177220 - DNA, 842 bp, Homo sapiens
  misc_feature: GYAE6OF02HY158.14.86.H09.1.454.CMB.1.raw
  modified_base (202)..(202): a, c, t, g, unknown or other
  misc_feature (202)..(202): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccacgccacctgtctttgtctccaaggggaancgccaccctctcctgcagggccagtcagagtgttagcctacctcttagcctggtaccaaacagaaacctggaccaggcctacccagccctccacactctctgatcgccttaccaacgaacggggcccaacgtcgggacctaacctaccccgaacgtcccgtacgggtttaccgacggttcgggacgtaggggttcgggggtaccgttagggggaacctaacgggttacctttaccgaaccttcccttaccaacccgtaacgtacccgtaacgtacccttaacccccgtaaggaccggtacccgttaaggggtaacggtttagttttttaacggtttaacggttttaactttaacccgttacggtttacctaaacggaacgttaacgttaacgtaacggtaccgtaacgggtccggttaccggtaccccgtttaccccgtttacccgggtttttaccggggaaccggggtaaaccggggtaaacccggttaaaagggggttaccggggaaacgttaacccggttaacccggtaaacggttaaaccggttcgggttaccggtaccgtaccggtaccgaacccgttacgtttacccgtttacggtttacccgttaccttaacccgtttcccgtttaacccccg

SEQ ID NO: 177221 - DNA, 601 bp, Homo sapiens
  misc_feature: GYAE6OF02G1SYC.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagcccaccctctcctgcagggccagtcagagtgtagcacctccttagcctggtaccaacagaaacctggccaggctcccagcctcctcatctctgactgccttaccaacgacgggccacgtcggcactcccagccaggttccaggtcggcaggtcgggtcgtgggacagtacttcactctacaccatcagtcctccgtagcgctggattagttttgtagtttacttacgtgtcctagtctaagttactgactacgtcgtcggtcccctaccgtacgtttcgggacgggaaccgggtaacgtaagggtggtaacgacgtacccgaacggtacggtcggtcggacgttcggacctaccgtattccgttacgttcctttaccgtactttcccgtacccccg

SEQ ID NO: 177222 - DNA, 598 bp, Homo sapiens
  misc_feature: GYAE6OF02H2NOA.14.86.H09.1.454.CMB.1.raw
  modified_base (205)..(205): a, c, t, g, unknown or other
  misc_feature (205)..(205): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagngccaccctctcctgcagggccagtcagagtgttagcacctcttagcctggaccaanagaaacctggccaggctcccagcctcctcatctctgatgcttccaacngggccactcggcactcccagcctaggttcagtggcaggtgggtctgggacagacttcactctacaccatcacgtcctcctagacgtccgtaggagttattttgtagtttattacgttgtactagtcgtagtatagcacgtcgtcggtcccttcccgtaccgtttccgggaccgggtacgggtaaccggaaagggtaggagtaccgtaccgaaccggtaacgtgggtacgggtcttacggaccacccgtacgttccttcggttacctttaccgtacttcccttacccccg

SEQ ID NO: 177223 - DNA, 703 bp, Homo sapiens
  misc_feature: GYAE6OF02IY1IB.14.86.H09.1.454.CMB.1.raw
  modified_base (234)..(234): a, c, t, g, unknown or other
  misc_feature (234)..(234): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaagagcccaccctctcctgcagggccagtcagngtgttagccacctctagcctggtaccaacagaacctgccgaggcctcccagccctcctcactcctctgatcgtccttaccaacgacggggccacgtcggacacctcccgagtcccgtaggttacacggtggcgaggttcggggtcgtacgggacgtacgtaccttcgaaccgttctaccacctaactccgacggtccttaccccgtaaggaccgtccgttagggtagtttaacgtttttggtttaacgttttaattaccgtttacgttaccgtaaggtcttaaggttacgttacgtacgtaacggtccgttaccggtcccccttacccgttaccggtttaccggggaccggggttaacgggtaccgggtaaagggtcggaacgtaccgtacccgtaaacgtaccgtgggttacggccgtacgaccgaccgtattccgttgtttccgtaaccttccgttcccgtaccccg

SEQ ID NO: 177224 - DNA, 742 bp, Homo sapiens
  misc_feature: GYAE6OF02IM5MP.14.86.H09.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccagccaccctgtcctttgtctccgaggggaaangcccacctctcctgcagggccagtcagagtgttagcaccgtcttagctggtaaccaanacgaacctggccaggctcccagcctctcatctctgctgcttaccaacgaggtccagtgctacgtcccagcctaaggttcaggtggacctagggttcggggtctaggggaacctaggaccgtttacaccttccgtaccaaccgtattaccgacggtccttccccgtaaggtaccggtccgttagggtaacgtttagttttttacgggtaacgtttttaacttaccgttacgggttcgaacgttaccgtaaggtttaaccgaagggtcctaagggtaccgttccggtccctttacccccgttaaggttttcccgggggaccggggttaaaggggaaccccgtttaaaggggtccgggtaaacgtaaccgtttacccggaaaacgggtttacccgttagggttcccgggtacctacggtaacccgtaaccgttactccgggtttactttacccggttactaccgtttcccccgttaaccccgg

SEQ ID NO: 177225 - DNA, 567 bp, Homo sapiens
  misc_feature: GYAE6OF02H8NES.14.86.H09.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (397)..(397): a, c, t, g, unknown or other
  misc_feature (397)..(397): n is a, c, g, or t
  modified_base (537)..(537): a, c, t, g, unknown or other
  misc_feature (537)..(537): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagcccaccctgtctttgtctccaggggaaagngccaccctctcctgctgggccagtcagngtgttagctacctccttagcctggtaccaacagaaacctggccaggcctcccagccctcctcatcctctgatgtccttaccaaccgtagggcccacgtcggctactcccagcccgtaggttcaggtggcaggttgggtctagggacagtacttcactctcaccntcacgtcctaccgtagacgcgtggattattttgatttatctgtacagtcagttatgcagctcggtccctcccgtgttcgggcggacgggacgtagggtcgacgtactaccgaagtacggtgtacggctcgacctaccgtnttcgttcgttaccttctaccttcccgtccc

SEQ ID NO: 177226 - DNA, 766 bp, Homo sapiens
  misc_feature: GYAE6OF02HO6M8.14.86.H09.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (256)..(256): a, c, t, g, unknown or other
  misc_feature (256)..(256): n is a, c, g, or t
tcagcgtctagtaccacgaccggtgctcgatttagtgctatagacttgggtttgggggaggaactgctcagttaggacccagagggaaccatggcagccccagctcagccttctcttcctcctgctactctggctccagatatcaccggagaaattgtgttgacacagtctccagccaccctgtctttgctccgaggggaaangccacctntcctgcagggccagtcagagtgtagcacctccttagctgtacaanagaacctggacagctccagcctctcatctctgatcgcctttaccaaacgacgggccacgtcggaccactcccagtccctaaggtttccaggttcggacctagggttcggggtctagggggaactaaggtaccttttacgacttaccttaccaaccgtattaccgaacgttcccttacccgtaaggaacggtccccgttagggtaacgtttagtttttttacgggtaaacgtttttaactttaccggttggttaaccgtaacggtaccgttaaaggtttaacgttaacgggaccgtaagggttcccgttaccggggtaccccctttaccccggttaacgttttcccggggggaacccgggttaacggggtaaccccgtaaaggggttccggaacgttaaccgtaccccggtaaaacggttacgttcgggttaccggaccgttaccgggaccctaacccgtagtttccggttaccgtttaccgttaccgtacccgtttcccgtttacccccg

SEQ ID NO: 177227 - DNA, 577 bp, Homo sapiens
  misc_feature: GYAE6OF02IOCA9.14.86.H09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
  modified_base (405)..(405): a, c, t, g, unknown or other
  misc_feature (405)..(405): n is a, c, g, or t
  modified_base (494)..(494): a, c, t, g, unknown or other
  misc_feature (494)..(494): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctcttagcctggtaccaanagaaacctggccaggctcccagccctcctcatctctgatcgcttaccaacngggccacgtcggcactcccagccaggttcaggtcgcaggtgggtctggggactaggtcttacacgtctacaccatccgaagtcctacctagacnccgtggagttatttgtattattacgtgtacagctaagttatagctagctcggtaccctccgtagttcggacgggtaaggaccgtaaggnggaactacgtaccgaacgtaacgttgtacggcgttcgacgtacccgtattccgttactccgttacctagttcccctaacccgg

SEQ ID NO: 177228 - DNA, 643 bp, Homo sapiens
  misc_feature: GYAE6OF02H1J3D.14.86.H09.1.454.CMB.1.raw
  modified_base (264)..(264): a, c, t, g, unknown or other
  misc_feature (264)..(264): n is a, c, g, or t
  modified_base (583)..(583): a, c, t, g, unknown or other
  misc_feature (583)..(583): n is a, c, g, or t
tcagcgtctagtaccacgaccggtgctcgatttagtgctatagacttgggtttggggggaaggaggaaggactgacggtcccccaggagttcaggtgctgggcacggtgggcatggtgtggagttttgtcacaagatttgggctcaactctcttgtccaccttggtgttgctgggtcttgtgattcacgttgcagatgtaggtctcctgtcgccccacatggacactactttgctacacactcctgctgctcgacacccccttntcggggtcttcggtcccaggtccaccttgaacggagttctggtcctggtagcgtggtacgaaacccctgaagaccgaccctcacgccttagaccctgcccgaccgttctcgttgggttacctcacgttcagctaactcctaaggtacgtggggtagtacgagtcgtaggtacccgtcgtcgtacccggacccccgggtaacgcccggtaggtacggtcgggtctcgaccgacgtacgttacgttttagacgttagaaacgtaaacttctaacgaacgctacgactcttatacggtacgagtcgagtcgtaccaaccgtnttacctaccgacgtaaccctccgtaccaccgtactaccggaacgttacccgcttaacccg

SEQ ID NO: 177229 - DNA, 526 bp, Homo sapiens
  misc_feature: GYAE6OF02F0358.14.86.H09.1.454.CMB.1.raw
  modified_base (203)..(203): a, c, t, g, unknown or other
  misc_feature (203)..(203): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaanagccacctctcctgcagggccagtcagagtgtagcacctccttagcctggtaccaacagaaacctggccaggctcccagcctcctcatctctgatgcttccaacagggccactggcatcccagccaggttcagtggcagtgggtntgggacagacttcactctcaccntcagcctccctagcnccgtggagttattttgtagtttattacgtgtacagcagttatagcagctcggcccttccacgtttcggcggtagggacctaagggtcgagataccaacgaacgtgtggctgccactctcgtgttcctcacttctaccccg

SEQ ID NO: 177230 - DNA, 617 bp, Homo sapiens
  misc_feature: GYAE6OF02FWMG0.14.86.H09.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (350)..(350): a, c, t, g, unknown or other
  misc_feature (350)..(350): n is a, c, g, or t
  modified_base (451)..(451): a, c, t, g, unknown or other
  misc_feature (451)..(451): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagttctccagccaccctgtcctttagtctccaggggaaangccacctctcctgcaggccagtcagagtntagcacctcttagcctggtaccaanagaacctggccaggctccagcctctcatctctgatgcttccaagaggccactggcatcccgagcctaggttccagtggactagtgggtcnggggacagacttcactcgtcaccgatccgacgtcctacccgtaagacgccgtaggtacgttattttagtagtttacgttacgtgttaccagtctaagttanaaggtcaggtctaggtcccttacccgtaacggtttccgggacgggtaacgggaacctaaagggttcggacggtaaccttaccgaaaacggtaaccgtgggtaacggtccgtaacggacctaacccgtattcccgttagttacccttactacgttcccttaccccgg

SEQ ID NO: 177231 - DNA, 608 bp, Homo sapiens
  misc_feature: GYAE6OF02FG4R1.14.86.H09.1.454.CMB.1.raw
  modified_base (204)..(204): a, c, t, g, unknown or other
  misc_feature (204)..(204): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagngccacctctcctgcagggccagtcagagtgttagcacctccttagcctggtaccaacagaaacctggccaggctcccagcctcctcatcctctgatgccttccaacgagggcccagtggcactcccagcctaggttcaggtggcagggtgggtcngggacagacttcactctcaccntcanctccagcncgtggatattttggtagtttatactgttcagactagtatagacaggtctggaccctcccgtacgtttccggggacgggtaacggaacccgaagggtcgggaacgtacgttacccgaaacggtaacggtttacgggcgggtacccttacgggacctaacccgtaacgtttccgtttacggttacctttacccgttacgttaccccgtttcccccgg

SEQ ID NO: 177232 - DNA, 717 bp, Homo sapiens
  misc_feature: GYAE6OF02JEPGI.14.86.H09.1.454.CMB.1.raw
  modified_base (153)..(153): a, c, t, g, unknown or other
  misc_feature (153)..(153): n is a, c, g, or t
  modified_base (198)..(199): a, c, t, g, unknown or other
  misc_feature (198)..(199): n is a, c, g, or t
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
tcagcgtctagtaccacgaccggtgctcgatttagtgctatagacttgggtttgggggagggaacgtggctcagttaggacccagagggaaccatggcagcccagctcagcttctcttcctcctgctactctggctcccagatatcaccgganaaattgtgttgacacagtctcagccacctgtcttgctcgaggaannccacctnactgcaggccagtcagagtgtacgctacctcctagcctagtaccanacgtaaccgtgcgaggtccaccgacgccctacctcctactcctcttcgatcgccttaccgaacgtacggacctacgtcggcctacgtcccacgtaccgtacggttacgtacggtcggacgtaggttacggggtcgttacgggaactaaggtaccttacgtaccttacgtaccctaaccgacgtacgtaaccgtaccgttacccgtaggtccgtaccgtagggtacgtttagttttaggttaacgttttaagttaccgttacgttacgtaccgtacgttaagttacgtacgtacgtacggtacgttcgtaccccttaccggtttaccgttaccggacggggttaaaccgggtaccggtaaacgggtacgaacggtacgttacccgaacgtaccggtgggttacgccttacgaccgttacctaacgttcgttaccgttacgttaccgttaccgtaccctttaccccg

SEQ ID NO: 177233 - DNA, 652 bp, Homo sapiens
  misc_feature: GYAE6OF02HVVKN.14.86.H09.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagngtgttagcacctcttagcctggtaccaanagaaacctggccaggcctccagcctcncatctctgatgcttaccaacgtacgggccactcggcactcccagccaggttcaggtggctaggtgggtcgtaggggacaggtaccttcacgttcctaccaacctataccacgtccctacccgtaggacgtccgttaggaacgtttatttttaggtagtttactttacgttcgttacgtagtactagttatagcagtcgtcggtcccttacccgtacgtttccgggaccgggtaacgggtaaccggtaagggtacggaacgtaccgtacccggaaacggtaccggttgggtaccggtaccttacggacccgtaaccgttacgttccttaccgttccgtttacttacccgtttccccgttacccccg

SEQ ID NO: 177234 - DNA, 677 bp, Homo sapiens
  misc_feature: GYAE6OF02FP8AE.14.86.H09.1.454.CMB.1.raw
  modified_base (205)..(205): a, c, t, g, unknown or other
  misc_feature (205)..(205): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaatttgtgttgacacagtctccagccaccctgtctttgtctccaggggaaagngccaccctctcctgcagggccagtcagagttgtagcctaccgtacttacgccgttaggtaacccaacgacgaaaacccgtggacccaacggccctcccgacgtcccttccctctaattcctctgacttcgtccttaccgaaagcgggccacgtggacactcccgagcccgtagggttcaggtcggacgtagggttcggggtactgggaactacggtacttccaactccgtaccaaccgtagtccgaacgttccctaccgtaagaccgtaccgtaggtaacgttagttttaggtttaacgtttagttaccgttgtactagactagttactagcgtacgtcgtacggtccctaccgtaccgtttcgggacgggtaccgggactaaggggtcgaacgtacgtacccgaacgtacggtgtacggtacgtcgtaccgtaccagttccttacgttaccttacgtacttcccgtacccg

SEQ ID NO: 177235 - DNA, 559 bp, Homo sapiens
  misc_feature: GYAE6OF02GQQD5.14.86.H09.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
tcagcgtctagtaccacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctcctgtgccccacatggacacactttgctacacactcctgctgctgacccaccccttctggtcttgtcccaggtcaccttgaaggatctggtcctgtgctggtacgaaacccacagacgaccctcacgctgacctgcaccgtctcgtcggttcncactnagcaatcctagaagtgggtgngagctggactccgtcgaccggcccccgggaaggcccgtggacgtggcgtcgcgtactacttattttacgaatagaacgtaaacttctacgacgacacatcgtacgtagaggagctacgtctacacctatacctaccgaacgacctacccacaccacgaccgtacgtacgtacctaaccg

SEQ ID NO: 177236 - DNA, 700 bp, Homo sapiens
  misc_feature: GYAE6OF02JPISF.14.86.H09.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (424)..(424): a, c, t, g, unknown or other
  misc_feature (424)..(424): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaanacgcccaccctctcctagcagggccagtcagtacgtgttacgcctaccttccttagccttaggtaaccaacgacgaaaccgtcggaccacggtcctcccgacncccttccnctactcctcctagactcgccttaccgaacgacggggccctaccggtggacctacgtcccctaagcccgtaaggttccaagggttccggacgtggggttcggttaccggnggggaaacctcggtaaccttccgatcctaccgtaacccagtttcaccgtccttaccgacgacgccgttagtagttacgttttagttagtttactacgtcggtactagtacgtagttactacggactaacgtcgttccgtacccgtccgttacgttccgggtcgggtaacgggtaccgtaaggtcgggactacgtaccgtaaacgtcggtaggtacgttacgtcgtaacctacccgttaagttccgtaacgttcctaacgttccgttccggttaccc

SEQ ID NO: 177237 - DNA, 646 bp, Homo sapiens
  misc_feature: GYAE6OF02I6EE6.14.86.H09.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccacctgtctttgtctccgaggggaagngcccaccctctcctgcagggccagtccagagtgttagcacctccttagcctggtaccaanagaaacctggccaggcctcccagccctcctcatctctgatcgcttaccaacgacgggccacgtcggccactcccagcctaggttcaggtcggcaggtcgggtcgtgggacacgtacttcaccgtctaccacctatccgacgccttacccgtaggacgcccgtagggtacgttagtttttggttagttttacgttacgtcgttacgaagtccgtaagttaagttacgacgacgtcgtaccgggtccccttaccgtacgtttccgggacgggtaacgggtaccaaagggtcggaacgtaccgtacccgtaaacgtaaccggttggtacggcttaccggacctaccgtacttccggtacgttacctttctacgttcccttaccccg

SEQ ID NO: 177238 - DNA, 706 bp, Homo sapiens
  misc_feature: GYAE6OF02GJKPC.14.86.H09.1.454.CMB.1.raw
  modified_base (151)..(151): a, c, t, g, unknown or other
  misc_feature (151)..(151): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccgganaaattgtgttgacacagtctccagccaccctgtctttgtctccgaggggaaagcgccaccctctcctgcagggccagtcagagtgttagcacctctagcctaggtaccaacagaacctggccaggcctaccccgagcctcctcactctctgatcgccttaccaagcgggcctacgtggccactcccgaggtcctaggttccagggtcggaccgtaggttcggggttaccaggggaacctaacggtacctttaccaacgttcctacctaacccgtattaccgaacgttcccctccgtaagggaccgtaccgtagggtaacgttagttttttggtaacggttttaactacgttggtactaagtaccgtaagttacgtaacgcctaaggtccgttacggtaccccttacccggttaccggtttccggggacgggtaaccggtaaccgtaacggggttggaaaccgtaccttacccggaacggtaaccggttgggtaacggtccgttacgacccgtaactgtttccttaccggtactttccgtaccttcccgtaccccg

SEQ ID NO: 177239 - DNA, 664 bp, Homo sapiens
  misc_feature: GYAE6OF02GQLBP.14.86.H09.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaancgccacctctcctgcagggccagtcagagtgttagcacctcttagcctaggtaccaanacgaaacctggaccaggcctccagccctcctcagtcctctanacttgccttaccaacgcgggccctacgtcggacactcccagccgtaggttccagggttcggacgtagggttcgggtacgtaggggaacctaggtacctttacaccgttaccgtacccaccgtagtccgaacgtcccttacccgtaaggaccggtcccgtagggtacgtttagtttttaggtttaacgtttaacgtttacgtgtactacgtacttagttagtacgcgtacgcgtcgtacccttccgtacgtttcggacggtaagggacctaaggtcgaacgtacgtacgaacggtaacgtcgggtcgacgtcgaaccctacgttactccgttacgtcccttacgtaccgttccgtaccccg

SEQ ID NO: 177240 - DNA, 735 bp, Homo sapiens
  misc_feature: GYAE6OF02FHFI9.14.86.H09.1.454.CMB.1.raw
  modified_base (207)..(207): a, c, t, g, unknown or other
  misc_feature (207)..(207): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacaggtcctaccagccaccctgtctttgtctaccgaggggaancgccacctctcctagcagggcccagtcagacgtgtacgcaccttccttagcccttaggtaccaacgacgaacctcggccacgggcctcccgagcccctcctacactccgtactgatcgtccttaccgaacgcgggtaccacgtcggacctacgtaccccaggcccgtaagggtttccacgggttcggaccgtagggttcggggtactgggggaacctaggaaccctttcgaacctcttacccaaccacttaccaacggtcccttacccgtaggaccgtccgtagggtaacgtttaagtttttacgtaacggtttttactaaccgttgttaccgaacgtcgtaaagttacacggcctacggtcttaccggtaccccttaccccgttaaggtttacccggggacgggtaaccgggtaacctaggggtacgtaacgaccgttacccgaaaccggtaacggtttcggaggcctttaccggccgtaacctcggttccttaccgttaacctcctaaccgttcccgttaccccgg

SEQ ID NO: 177241 - DNA, 711 bp, Homo sapiens
  misc_feature: GYAE6OF02JLD5Z.14.86.H09.1.454.CMB.1.raw
  modified_base (686)..(686): a, c, t, g, unknown or other
  misc_feature (686)..(686): n is a, c, g, or t
  modified_base (694)..(694): a, c, t, g, unknown or other
  misc_feature (694)..(694): n is a, c, g, or t
tcagcgtctagtaccacgaccggtgctcgatttagtgctatagacttgggtttgggggaggaactgctcagttaggacccagagggaaccatggcagccccagcgtcagcttctcttcctcctgctactctggcctccagatatcaccggagaattgtgttgacacagtctccagccacctgtcttgctcgagggaagcgccacctctccgtgacagggccaggttccaggtaggtcgttaacgccgaccttcctttagggcccgttggtaacccaacgacgtaaacccgtgggaccaacggtcctaccccagaccccttccgtcaacttccacgtctacttcggtcctttaccgaaacgccgggtacccaagttcgggcctaacggttccccaagccccgtaaggttccaacgggttcggaaccgtaaggtcggggttacacggggtaacctaacgggttaccgtttacctaacggttcctaccgtacccgtaattacccgaggtccctaacccggtaggaccttccgggtaaggtaggttttattttaccggtaggttttaactccgttagtaccggtatacgtacgttaggacgtcaggtccacggttccctcgtacgttcggacggtacgcgtaaggtgatacgccaagtacgttcggagtccgagacctaaccgcgtttcnccgtttanccgacttccgttacccg

SEQ ID NO: 177242 - DNA, 536 bp, Homo sapiens
  misc_feature: GYAE6OF02JEFEL.14.86.H09.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (519)..(519): a, c, t, g, unknown or other
  misc_feature (519)..(519): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctgtaccaacagaaacctggccaggcctcccagcctcctcactctctgatgcttccaacngggccacgtggcatcccagccaggttcagtggcagtggtctgggacagacttcactctcaccatcagcctcctagacgcctggagtattttgtagtttattacgtgttccagtctaagtatagcagtctcggacccttcccgacgtttccggcgggtacgggaccaagggtggagacgtcgaacgacgtggtcgctcgacaccatcgtntctctacgttcctcccg

SEQ ID NO: 177243 - DNA, 752 bp, Homo sapiens
  misc_feature: GYAE6OF02F6K03.14.86.H09.1.454.CMB.1.raw
  modified_base (300)..(300): a, c, t, g, unknown or other
  misc_feature (300)..(300): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagaaattgtgttgacacagtctccagccacctgtctttgtctccgaggggaagcgccacctctcctgcgagggccagtcagagtgttagctaccttcttagacctggtaaccaacagtaaacctcggaccacggcctacccgagccctaccncactcctctagactcgacttacccgaacgacgggccctacgtcggaccacgtaccccgacggcctaacgggttcaggttcggacgtaggggttcgggtacgtaggggaactaacgtaccgtttacgactccgttaccaaccgtagtaccaacgtccctacccgtaacgggtacgtaccgttcgggtagttaacgttttttacgggtaactttttaacgtaacgttcggttactaaagtccgttaaaggttaacctagggtacctaaggtcccgttacgggtaccccttacccggttacggtttcccggggaaccgggtaacgggtaaccgtaaaggggcggtaacgtaaccgtacccgtaaaacggtacccgttagggtacccggtacgtaacggtacctaacgttacgttcggttaccgttaccttacggttacccttacggttacccccg

SEQ ID NO: 177244 - DNA, 699 bp, Homo sapiens
  misc_feature: GYAE6OF02H1QNT.14.86.H09.1.454.CMB.1.raw
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (659)..(659): a, c, t, g, unknown or other
  misc_feature (659)..(659): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctcccagatatcacggagtaaattgtgttagacacagtctccagccaccctgtctttgtctccgagggaagcgccacctctcctgcgacggccagtcagagtgtancacttctagctggaccaagacaaccgtgaccngacctccacgcctccgtcactctctagctcgtcctaccgaacgcggacctactggacctacgtccacgtccggtacgttcggacgtcggcgtaggttcggggtacgtacggggactaacgttctacctacgtaccgtaccaaccgttacgacgtaaccgtccgtttaccgaacggtacgttaccggttaacgggttacgtttaacgttttttgggtaaagttttaaccgttgtttacgtaccgtagttaccgttaagtacgttacgacgtaacggtcgtacggttccccttacgttaccgtcgggaaccgggtacgggtaccgaaagggtaccgacgtactacccggtaaagttcggtacggtacggctaacggtaccctaccggttntaccggttccgttaccgttactacccggttcctaccccgg

SEQ ID NO: 177245 - DNA, 748 bp, Homo sapiens
  misc_feature: GYAE6OF02JTY97.14.86.H09.1.454.CMB.1.raw
  modified_base (118)..(118): a, c, t, g, unknown or other
  misc_feature (118)..(118): n is a, c, g, or t
  modified_base (687)..(687): a, c, t, g, unknown or other
  misc_feature (687)..(687): n is a, c, g, or t
tcagcgtctagtaccacgaccggtgctcgatttagtgctatagacttgggtttgggggaggaactgctcagttaggacccagagggaaccatggcagcccagctcagcttctcttccncctgctactctggcctccagatatcaccggagaaattgtgttgacacagtctcagccacctgtctttgctccgaggggaacacgcctaccctctcctgcgacgggcctagtccaggtacgttggttaacgcctacccttccttaagcccgttaaggtaaccccaaacgaacgtaaacccgtcggacctaagggtccctacccgaacggtccccttaaccctctacgtccttcttggaactcgcctttaccgaaacgtacgggcctacggtcggacctaccttcccgacgtaccgtacggggttaccaagggttcggacgttagggttcggggttacgacggggtacacgtaaccgttcactccctacgacctaacgtctaaccgtccgttaccgtaacgtcgaccgttagggttaaccttagttttaggttactttaagttccgtagtacgttacgtacgttaagttaccgtaagtcaccggttctacccgggtcccttcccgggttaacgtttaccggggaccggtaacgggaccgtagggtaggacgtaccaccggaacgtaacggnggttccgcacgtacccgtaatcgttaccgttcggttactaccggtccctacccgttacccg

SEQ ID NO: 177246 - DNA, 679 bp, Homo sapiens
  misc_feature: GYAE6OF02I79G5.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgccagggccagtcagagtgttagcaccttcctagcctgtaccaacagaaacctggccagctccagcctccctcatctctgactcgtcttaccaacacggggcccaacgtggcactcccagccaggttcagtggctaggtggtctgggacagtacttcactctcacctatccacgcctacccgtaagacgtccgtagggtaattagtttttaggtacgttttattacttcgttcgagtacgtaagttagtagtacctacggtcttccgggtaccccttacccgttacgttttcccgggggacgggtaaccggggaaccggtaaggggtttcgggaacgtaacccgttaccggtaaaccggtaaacggtttcgggtacgggacccgttccggaaccgtaacccggttaattcccggttttaccgttaccgtttacccccttaacgttcccccgtttaccccccg

SEQ ID NO: 177247 - DNA, 761 bp, Homo sapiens
  misc_feature: GYAE6OF02GRGFU.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccaaccacctgtctttgtctccaggggaaagngccaccctctcctgcagggccagtcagagtgttagcacctccttagcctggtaccaacagaaacctggaccaggcctcccgagaccctcctcatctctgacttcgccttaccgaacgacgggcccacgtcggcctactccccaaggcccgtaggttccaggttcgggactagggttcggggttaccgtcggggaacctaagggtaccctttctaaccttccgttaccaaacccgtagttaccgaacgtcccgttaccccgtaaggtaccggtcccgttaaggggtaacgtttagttttttaacggtttaagtttttaactttaccggttacggttaccgtaaggtccggtaaaggtttaaacgttacggccgtaaggtccgttacgggtacccccttacccggttaccggttttccgggggaacgggtaaccgggtaaacccgttaagggtacgggaaagtacctaacccggaaacggtacgttcgggtacggtacctacggaccctaccgtattccggttcgttacccgttactaaccgttcccgttaccccgtacc

SEQ ID NO: 177248 - DNA, 580 bp, Homo sapiens
  misc_feature: GYAE6OF02GJFZW.14.86.H09.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaangccaccctctcctgcagggccagtcagagtgttagcacctccttagcctggtaccaanagaaacctggccaggctcccagcctcctcatcctctgatgcttccaacgngggccacgtggcactcccagcctaggttcagtcggcaggtgggtctgggacagtacttcactctcaccatcacgtcctcccgtagactcgtggtattagttttgtagtttatacgtgtcagtctagtatagcagtcgtcgccctccgtacgtttccggacgggtacgggaccgtaagggtcggacgtacgtacccgaacggtacgtcgggtacggcgttcgacctaccgtacttccgtcgtttaccttacgtaccttcccgttaccccg

SEQ ID NO: 177249 - DNA, 819 bp, Homo sapiens
  misc_feature: GYAE6OF02GTOER.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaagagccaccctctcctgcagggccagtcagagtgtagcacctccttagcctggtaccaacagaaacctggccaggctcccagcctcctcatcctctgatcgtccttaccgaacgacgggccacgtcggacctaacctccccgaagcccgtagggtttaccaggttcgggaccgtaggggttcgggtccgtaggggaaccaaggtacctttaccgaacttcccgtacctaacccgtagtaccgaacgtcccgttaccccgtaaggtacccgtacccggttagggtaacggtttaacgttttttacgggtttaaacgttttacgtttaaccgtttacgttaccgtaacggtaccgttaaagttacgtaacggtccgtaacggttccgttaccgggtaccccctttaccccggttaccggttttacccgggggaccggggttaacgggggtaaaccccggtaaaggggtaccgggtaaacgggtaacccgtacccggttaaaccgggtaaccggttacggggttaccgggtaccggttccggtaacccgtaacccgttacggtttacccgtttaccgtttacccgtttaacccgtttacccgtttaccccgttaccccccgg

SEQ ID NO: 177250 - DNA, 661 bp, Homo sapiens
  misc_feature: GYAE6OF02JUV6X.14.86.H09.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
tcagcgtctagtaccacgaccggtgctcgatttagtgctatagacttgggtttgggggaggaacgtgctcagttaggacccagagggaaccatggcagccccagctcagcttctcttcctcctgctactctggctccagatatcaccgganaaattgtgtagacacgagtctcagccacctgtctttgtctaccgaggggaanacgccaccctctctgccgagggcctaggtcagtacgtgttacgcctacctccgttagccgtggtaaccaacgacgaaaccctggcccaaggcctaccacggcccttcncgtacttcgcttcgatcgtccttaccgaaancgggacctagtcggacctcgtcccaagcccgtagttcacggtcgacgtaggtccggtcgtgggaacctagggtaccctttnaccgtctaccgtaacgntaccgtacgtcctacgtagtacgcgtaggtattacgtttagtacgtttatactgtacgtagtacgtagtacgagtacgtacgtcgtccgtcccttaccggtacggttccgggagggtaacgtaccggaaggtcgaacgtaccacgtacggtacgtcggtacgtccgtacggtaccaccgttcgttcggttaccgtttccgtacgtcccgttcccgtaaccg

SEQ ID NO: 177251 - DNA, 772 bp, Homo sapiens
  misc_feature: GYAE6OF02G5CMG.14.86.H09.1.454.CMB.1.raw
tcagcgtctagtaccacgaccggtgctcgatttagtgctatagactttgggtttggggggaggaactgctcagttaggacccagagggaaccatggcagccccagctcagcttctcttcctcctgctactctggctccagatatcaccggagaaattgtgttgacacagtctccagccaccctgtctttgtcctccaggggaaagacgccaccctctcctgcagggccagtcagagtgtagcacctcttagcctggtaccaacagaaacctggaccaggctacccagcctcctcatctctagatcgccttaccgaaacgacgggcccaacgtcgggacctatccccaagcccgtagggtttaccagggtcggacgtaggtcggggtcgtaggggaactaaggtaccttttaccgacctttacctacccaaaccgtaacttaccgaacgtcccgttaaccccgtaacggtaacggtcccgttaagggaacgtttaagttttttaggttaaacgtttttaagtttaaccgtttacgttacgtaacggtacttaaagttaacgttaacgtaccgtaacggtccgttaccgggtacccctttacccgtaacccgttttcggggaaccggggtaaggggtaacccggtaaagggttacggggaaacgttaacgtaacccgtaaacgtaaaccggttcggtacgggtacctcggtaacccgtaacctacgttaccgttacggtttaccttacccttaacgttccccgttaacccccgg

SEQ ID NO: 177252 - DNA, 764 bp, Homo sapiens
  misc_feature: GYAE6OF02FNODI.14.86.H09.1.454.CMB.1.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctcggctcccagatatcaccggagaaattgtgttgacacagtctccagccaccctgttctttgtctccgaggggaaangccacctctctgcgagggccagtcagngtgttacgcacctccttagcctggtaaccaacgacgaacctcggccaggcctcccagcctcctcactcctctgactcgtccttaccaacgtcgggccagtcggctactcccaagccgtaggttcaggtcggcgtagggttcgggtacgtacgggactacggtacttcaccttctaccaacctctaccgacgtccctacccgtaggaccgtccgtagggttatttacgtttttagggttaattttaacttaccgttagggttaccgtacggtacgtaaggttaacgttacggaccgtaacggtccgttaccgggtaccccgtttacccggttacccggggttttaccgggggaccggggttaaaccgggtaaacccgtaaacggggtttacggaaccggttaccgttaaccccgggaaacggtaaccggtttacggggtaccgtacccggttacggaacccgttaacccggttcgttttacccggttccgtttaccctttacccggttaaccttccccccgtttaaccccgg

SEQ ID NO: 177253 - DNA, 560 bp, Homo sapiens
  misc_feature: GYAE6OF02G773F.14.86.H09.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaagngccacctctcctgcagggccagtcagagtgttagcacctcttagcctggtaccaanagaaacctggccaggctcccaggcctcctcatgtatgatgcactcccacgacgggccaccggcatccccagccaggttccagtcggcaggcgggtctgggacagcttcactctcaccatcagcagcctagagtctagaagtacttttgctagttttattacgttgttacagcgaggcgggtactagttcgggccgtctccgtacgtttcggggccgggggtaacctagggtggtacgttacgaacgtacgtggtcggctggacctacagttcttcgttacttcgtacttccgtacccgtcc

SEQ ID NO: 177254 - DNA, 666 bp, Homo sapiens
  misc_feature: GYAE6OF02FWO94.14.86.H09.1.454.CMB.1.raw
  modified_base (202)..(202): a, c, t, g, unknown or other
  misc_feature (202)..(202): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaangccaccctctcctgcagggccagtcagagtgttagcacctcttagcctggtaccaacagaaacctggccaggcctcccacgcccccctcactctctgatcgccttccaacgacgggcccactcggccactcccagccgaggttcaggtggcaggtcggggtctggggaacaggtacttcacgtctccacacgttcacgcctacccgtagacgtccgtagggtacttagttttagttacgtttttactttactttcggtactaggttctaagttacgttaacgctaagtccgtaccggtccctacccggttacgtttccgggaccggggtaccgggtaccgtaaggggtacggaaggtaccgtaacccgtaaaccggtacgttagggtcggtaaccggttcggaacccgtaacccgtaagttccgttactttcccgtaccgttatttccccgttaccctacccgg

SEQ ID NO: 177255 - DNA, 723 bp, Homo sapiens
  misc_feature: GYAE6OF02HGZ50.14.86.H09.1.454.CMB.1.raw
  modified_base (205)..(205): a, c, t, g, unknown or other
  misc_feature (205)..(205): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtcttttgctccgaggggaaacngccacctctcctgcagggccagtcagagtgtagcacctctagcctagtaccaanagaaaccgtggaccaggcctcccagcctcctnatcctntgactcgccttaccaacgagggtccaacgtcggacaacctccccgagaccgtaggtttccaggttcgggactagggttcgggggtcttacgggggaactaagggtacctttcgtaccgttactcccgtaaccctaattacccgacggtacccttacccccggttaaggaccgtaccccgttaggggtaacgtttactttttaggttaagttttaacttacgtacgttaccgtagtaccgtaagttactaggactacgggtctcgggtaccccttaccctttaccgggtttccgggacgggtaaccggggtaaccgtaaagggttgggaaccgttagtacccgtaaaggtaccggttgggtacggtcctaacgacgttaaccgtcttcgttacggttcctttaacggtcccttacccgttaccccgg

SEQ ID NO: 177256 - DNA, 840 bp, Homo sapiens
  misc_feature: GYAE6OF02HKLPX.14.86.H09.1.454.CMB.1.raw
  modified_base (205)..(205): a, c, t, g, unknown or other
  misc_feature (205)..(205): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaatttgtgttgacacagtctccagccaccctgtctttgtctccgaggggaaangccaccctctcctgcgagggccagtcaggagtgttagcctaccttccttagcccgttaggtaacccaaacgaacggtaaacccttgggaccctaaggggcccttacccccgacggtcccccttacccttccaacttccttcgttagtaacttcggtcccttttaacccgaaacggtaccgggggacccctaacggttcgggaccctaaccgtcccccgaaggaccccgttaggggtttaccaagggttccgggaccgttaagggggttccgggggtacgttacggggggaaaccctacgggttaaccctttcccggaacctttacccgttacccgaaccccgtaagtttaccccgtaacggtaccccgtttaaccccggtaagtaacccgggttcccggttaaggggttaacggttttagtttttttaaccgggtttaaaggtttttaacctttaacggttcgttaccgtaaggtacctaaagttacgtacggacctaaggttccgtaccggttcccttacccggtacgtttccggggacgggtaaccggtaacggtaacgggtggacgtacgtaccaacggtacgtggtcggcgtcgaccacgtacgtctgttaccttcgtactcccgtacccg

SEQ ID NO: 177257 - DNA, 644 bp, Homo sapiens
  misc_feature: GYAE6OF02FVIAO.14.86.H09.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagcgtctagtaccacgaccggtgctcgatttagtgctatagacttgggtttgggggagggaacgtggctcagttaggacccagagggaaccatggcagcccagctcagcttctcttctcctgctactctggctcccgagatatcaccggagaaattgtgttgacacagtctccagccacctgtctttgtctccgaggggaaancgccaccgttctccgtgccagggccaggtcagtagtgttaacgctacctctagcctggtaaccagaacaacctggcacggcctacccagtccctaccncgtactcctctggactcgccttaccaacgcggccacgtggctactcccagccgtagtcaaggtgccgaggtcggctaggacaggtaccttacgcgttctacaccgtagtacacgtacctccgtaggccgtaccgtagggtaacgtttagttttacgttaagtttacgttacgtacgtcgtaacgtagttaacggttacgtaacgtcgtacggttcgtaccggttacctacccggtaccgtttcggaccgggttaacggaccgtaagggtacgacggtaactacggaacgtacggtgtacgcgtacgagtaccgtagtcgttcgtactctacgtccctacgg

SEQ ID NO: 177258 - DNA, 774 bp, Homo sapiens
  misc_feature: GYAE6OF02H7TKZ.14.86.H09.1.454.CMB.1.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
tcagcgtctagtaccacgaccggtgctcgatttagtgctatagacttgggtttgggggaggaactgctcagttaggaccagagggaaccatggcagccccagctcagcttctcttcctcctgctactctggctcccagatactcaccgggagtaaattgtgttgacacagtctccagccacctgttctttgtctcgaaggggaaancgccaccctctcctgcgacgggaccngtccaggtagttagttagcctacccttcttacgccttagggtaaccaaacgtacgaaacccgtcggaccgacgggccttaccccgacgtccccttcctactacttccttacgtacgtacgttcttaccgtttaaccgaaacggaccggggaccctaacggttcggaacctccgtacccgacgtaccgtacggtcgtaaggtcgggtacgtaggggttcgggtacggtagggaacgttacgttaaccgttctacccttctaaccctaccgtacgtaccgtaaccgttcccgttacccgtaggtacccgtaccgggttaggtaacgttttagtttttaacgtttaagtttaccgtttgttacgttacgacgtaacgtagttacgacgtacggtacgtacggttcccgtacccttccgttaccgggttccgggaaccgggtaaccggtacgggtaagggtacgtacggaacctacgacggttaccgtggtaccgtcgtaccgtacgaacgttcgttacttcgtaccttcttcccgtccttacccg

SEQ ID NO: 177259 - DNA, 693 bp, Homo sapiens
  misc_feature: GYAE6OF02GZYX4.14.86.H09.1.454.CMB.1.raw
tcagcgtctagtaccacgaccggtgctcgatttagtgctatagacttgggtttggggggaggaactgctcagttaggacccagagggaaccatggcagccccagctcagcttctcttcctcctgctactctggctcccagatatcaccggagaaattgtgttgacacagtctccagccaccctgttctttgtctccgagggggaaagacgcccaccctctcctgcgagggccagtcagagtgttagccaccttccttagcctggtaaccaacacgaaacctggaccaggcctcccagcccctcctcactctctgactcgtccttacccgaacgacgggcccacgtcggctacgtaccccgagtccgtaggttcaggtcgacgtagggttcggggtaccgtagggaccgtagtaccgttacaccttctaccaccacgtacacgtccttacccgtagacgtccgtagggtaatttcgtttttagttacgttttaacttacgtgtacaacggtctaaggttactaacgcgtacggtccgttacggttccccttacccggttacggtttccggggacgggtaaccgggtaccgtaaaggggtcggtaacgaccttaaccgaacggttaccgttggaccgggttacctcggaccaccttacgttcgttacgttcctttacctaccgttcccttacccg

SEQ ID NO: 177260 - DNA, 708 bp, Homo sapiens
  misc_feature: GYAE6OF02H88V8.14.86.H09.1.454.CMB.1.raw
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (282)..(283): a, c, t, g, unknown or other
  misc_feature (282)..(283): n is a, c, g, or t
  modified_base (290)..(290): a, c, t, g, unknown or other
  misc_feature (290)..(290): n is a, c, g, or t
tcagcgtctagtaccacgaccggtgctcgatttagtgctatagacttgggtttggggggaggaactgctcagttaggacccagagggaaccatggcagccccagctcagcttctcttcctcctgctactctggctcccagatatcaccggataaattgtgttgacanagtctccagccacctgtctttgctccgagggaaancgccaccctctccngcacgggccagtcagtgtgtancctactcttgccttgacaacagaacctgcagtcctccagcctcnnctctctnactctccttaccaacggtcggacctccgtcggctaccgaccctacggacccttaggggttcagggtacggtcgtaagggttcggggtaccggtgggaacctacgtacctttcaccctctaaccacgtagtcctacgtccctacgtaggaccgtcgtacgggtatttagtttacgttaacgtttacttcgtacgtacgtacgtacgtaacgttaagtcccgtagtaccggtccgtaccggtccccgttaccgttaccgggttcgggaaccggggttaacggacccgggtaagggtaacgtaccgggtaacctaaccggtacgttaaccggtcgtaaccgggtacgttacccggaacccgtaccgttccggttactttccggtttaacgtacccgttttacccgttcccttaacccccgg

SEQ ID NO: 177261 - DNA, 687 bp, Homo sapiens
  misc_feature: GYAE6OF02FIZVQ.14.86.H09.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccgganaaattgtgttgacacagtctccagccacctgtctttgtctccgaggggaangccacctntcctgcagggtccagtcagagtcgttacgcaccttcttagcctggtaccaacgacgaacctggaccaggcctccacgtccgtcctacactctctcggattgccttaccaacgacggggcctaacgtcgggcctaacgtccccgaaggtcccgtaagggttccaaggttcgggctagggttcgggggtcttacgggggaaccacggtacctttaccaccttcctcccgaaccctactccaagtccctcccggtacgacgtccgtagggtacgttacgtttttacgttaagttttaacgttacctacgtctaaggtcgtaacgttaatacgcgtaacgtcgttacggcccttacccgtacgtttccggacgggtaacggtaccgaagggttcggaagtcctaccgaacggtacgttcggtcggaccttcgacctacgactttccggtcgtacctttacctacgttaccccgttacccgg

SEQ ID NO: 177262 - DNA, 832 bp, Homo sapiens
  misc_feature: GYAE6OF02JOQFO.14.86.H09.1.454.CMB.1.raw
  modified_base (203)..(203): a, c, t, g, unknown or other
  misc_feature (203)..(203): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctccagatatcacggagtaattgtagttgacacagtctcacgccacctgtctttcgtctaccgaggggaancgcctaccctctcgtgcgacggccgagtacagtagttgttacgcctaccgttccttacggccgttacggtaaccaacgacgtaaaccgtcggaccacgggtccctacccgagtccccctctacgtacttccttacgtagtaccgtcggtaccccttaaccggaacggtccgggaccctaacggttccggacctaacgtaccccggaggtacccgttagggttaccgagggtacggtacggttacgggttacgggggtaccgtacggggaaaccttacggttacctttaccgtacccgttacctaacccctaaaccgttacgtcccgtaaacggttccccctttaaccggtaaggttacccgggtaccgtttaacgggggtttaagtttttaacgtttttaacggggtttaaacgtttcccgttaaaggttccgggtacttaaacggtagtttaaaccggtctaaccgggttccgaacggttccggtacccgtaccgtttacccggttagggtaacccggggtggtaaaccggggactagggtacccgtaggtaacccgtacggtagtaccggtcgggtacgacgtccaacgtcctaggtttccctgtttacaccttacgtcccgtaacg

SEQ ID NO: 177263 - DNA, 841 bp, Homo sapiens
  misc_feature: GYAE6OF02GY21K.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggctccagatatcaccggagtaaattgtgttgacacagtctccagccaccctgtctttgtctcgaggggaaagacgcccaccctctccgtcgcgacgggccagtcagagtgttagcctaccttccttaacgcccgttacggtaacccaaaccgaacgaaaacccgttcggaccgaacgggtccccttaccccgacgtcccccttccctacctacgttccttcgtcgacgttcgtaccctttaaccccgaaaccggacggggtacccctaccggttccgggaccctaaccgtcccccgaacggtcccggttaacgggttccgtaagggttaccggaccggttaaggggttacggggttacggtacggggtaacgaacggttaacctttccgtaaccttccgtaacccaaccctaccgtaccgacgtacccgttaccgtacggaccgtacccggttaggtaacgttttacgttttaggtttaacgttttagttaccgttcgtacgtacgtacgtagttaagtacgtactacgtcggtccgtcccgttacccggtttacggttcccgggtacggggtaaccgggtaaaccggtacgggtaacggtacgtaaccgtaccggtaacggtaccggtacgggttaccggtacctaccggtacccttaaccgtacgtttcttacggttacccgtttcgttacccgttcccgttaacccg

SEQ ID NO: 177264 - DNA, 674 bp, Homo sapiens
  misc_feature: GYAE6OF02FO9XD.14.86.H09.1.454.CMB.1.raw
  modified_base (206)..(206): a, c, t, g, unknown or other
  misc_feature (206)..(206): n is a, c, g, or t
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
tcagcgtctagtaccacgaccggtgctcgatttagtgctatagacttgggtttggggggaggaactgctcagttaggacccagagggaaccatggcagccccagctcagcttctcttcctcctgctactctggctcccagatatcaccggagaaattgtgttgacacagtctccagccaccttgtctttgtctaccgaggggaaancgccaccctctcctgcgaggccagtcagagtgtacgcctaccttccttacgcctcggtaaccaacgaacgaaaccgtcggaccacggcctcccacgtcctcctcactcctctgactcgccttaccgaacgcggaccacgtcgaccacgtacccngaccgtggtacaggcgtacgcggtgggtcgcgggaacncgtacttcgactctacacctatccgacgtcctacccgagtccggccgttagggtacgtttaggtttttcgttaacgttttattaccgtcgttaaccgtaggaccgttaagtaacgtcggacctcggtaccgttccggtacccctcccggtttaaggttcccgggacgggtaacggacggtaaggtacggacgtaccgttaccggaacggttacggtcggacggtccgtacgaacctcgttacttcgttcgttacctccgttaccgtcccgttcccg

SEQ ID NO: 177265 - DNA, 826 bp, Homo sapiens
  misc_feature: GYAE6OF02GHB9P.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggcctcccagatatcaccggagaattgtgttgacacagtctccagccaccctgttctttgtctccgaggggaaactcgccaccctctcctgccgacgggcctagtcaggtagttgttacgcctaccttccgttaggccttcgggtaaacccaaacgtaacgtaaaacccgttcggacccgtaacgggcccttacccccgaacggtcccccttcccttaccacttccttcctaggtaacttcgtcccgttacccaaaccggacggggccctaaccgttcgggacccaccgttacccccgacggtaccccgtagggtttaccgacgggttacggggacccggtaggggttccgggggtcggtacggggtacgtaaccgtaactttcccgtaaccttacctcccgtaaccgtcttaccgaaccgtcccgtaccgtaacggaccggtccgtaggggttactttacgtttttacggttaacgtttactttaacgtcgttacgtacgtaccttaagggttaactttacggacttaacggtccgttccgggtacccctttacccgtttaccggggttacggggtaccggggtaacgggtaacccggtaggtaacgggaccttacgtaaccgagtaacggtcggtcggacctacgacctaccggtacttccgttagtttccctaacttcccgtaccgtttcccg

SEQ ID NO: 177266 - DNA, 728 bp, Homo sapiens
  misc_feature: GYAE6OF02GX3AX.14.86.H09.1.454.CMB.1.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccacctgtctttgctaccgagggaaagcgccaccctctcctgcgagggccagtcaggtagtgtacgctaccttctgcctggaaccanaagaacctgcgacgtcctcccgacgtcccccgntactctcgtagtactcgtcttaccgaacgtcgggacctacgcggcaccgtccgacgccgtacgttcgacggtcggacgtacggttgggcgttagggactacgtacttaccacttccacgtaccagtaccgacgtcccgtaccgtacggaccgtccggtaggttaacgtttacgttttaggtttacgttttaacgttacgttacgtacgtacgttacggtaacgttaagttaacgcgtaccgtcggtaaccggtccccgttacccggttaccggtttaccggggaacgggtaacccgggtaaccgttaagggggtccggtaaacggtacccggtaaccgtaaccggtaacggttcggtaccgtaccgttagtaacccgtaccgttacgttcccgttagttacccttcgtaaccccgttccgttacccgtacccg

SEQ ID NO: 177267 - DNA, 892 bp, Homo sapiens
  misc_feature: GYAE6OF02I4S3T.14.86.H09.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctgctccagatatcacgganaattgtgttgacactagtctccagccacctgtctttgctacgagggtaaancgccacccgtctcctgcgacggcctagtcagtagtgttacncgtaccttccgttagcctacgtaaccaacgacgtaaaccttcgggaccctaggtcccgttacccgacgtccccgtacctactaacgttcctaccgttcgaacttcgtacccctttaaaccgaaccggtacggggtaccctaacggttcgtaccgtaaccgtccccaagggtcccgttaacggttaccgtaacgggttcggaccgtagggttacccggggtacgtaccgggggtaaactaacggtttaccgtttaccgtaaccgtttccggtacccgtaaaccgtaacggtttccgaacccgtttacccgttacccggttaacgtaaccgggttccccgtaggggtttaaacgtttcgttttttacggtaacgttttaaacgtacccgttacggttaccgtaaggtttaaccgacgggtttaaactaaccgggtctaaaccggggtttcccgtaccggttacccccgtttaaaccgggttttcccgggggttaacccgggtaacccgggggtaaccgggtaaaacccgggttgggtttaaccggaaccgtttaaccggtacccggttaaagggtacccgttgggtccgtactaacggttccgtaaaccgttcgtaccgttccggttactaacccgttaccgtcccggttaacc

SEQ ID NO: 177268 - DNA, 727 bp, Homo sapiens
  misc_feature: GYAE6OF02GIKS2.14.86.H09.1.454.CMB.1.raw
  modified_base (297)..(297): a, c, t, g, unknown or other
  misc_feature (297)..(297): n is a, c, g, or t
  modified_base (674)..(674): a, c, t, g, unknown or other
  misc_feature (674)..(674): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctcccagatatcaccggagtaaattgtgttgacacagtctccagcccaccctgttctttgtcctccgaaggggaaagacgccaccctctcctgcacgggccagtcagtagtgtagccaccttccttacgcctgtaaccacacgaaccgtcgcgacggcctaccncgtccctccgtctactcctctacgatcgtaccttaccgaacgtacgggaccacgtcggtacccaccgttaccccgacggtacccgtaagggtttaccgagggttcggacggttacgggttacggggtcggttagggaacctaagtacccgttacaccgttcacccaacccgtacgtaccctcgtacccgtcccgtaggacccgtctttacggggtaactttacggttttagtttaacgtttacgttacgtacgtgaactcgtaacgttgaactcgtacgtcggttccgacccgttccgttaccggtcgggtaccgggtaacggtacccggtagggtcggaacgtaccgtacggaaccgtcggtaacgtgggttaccncgttaccgacgttacgttaccggtcttacttaccgttcgtacccgttaccccg

SEQ ID NO: 177269 - DNA, 914 bp, Homo sapiens
  misc_feature: GYAE6OF02GRHNE.14.86.H09.1.454.CMB.1.raw
tcagcgtctagtaccacgaccggtgctcgatttagtgctatagacttgggtttgggggaggaactgctcagttaggacccagagggaaccatggcagccccagctcagcttctcttcctcctgctactctggcctccagatatcaccggagaaattgtgttgacacagtcctccacgcccaccctgttcctttcgtcctccgaggggaaagacgcccaaccctctccgtgcgacggggccacggtcagagtgttagcctaccttccttagcctacggtaaccaacgaacgaaaacctcgggaccacggcctaccccgacgtcccctccgtaccactccgttctgactcggtccttaccaacgaccggggtacctacgtcggactaccgtaccccacgtcccggtaacgggttacacgggttacggggaccgttaacggggttcggggggtaccggttacgggggaacgtaacccggtaaccgttttaccgtaccctttaccgaaccctaacccgtaacgttaccccgtaacgtcccccggtttaaccccgtaaggggtacccgtaccccgggtttaagggtaaccggttttacgtttttttaacggtttaaacgggttttttaaccttttaaccgggtttccgttaaacggtaacgggtttacccttaaaggtttaaaccggaccgttacgtaccgggttacccgttccggggttaacccccttttacccccggtttaacggggtttccggggaacccgggggtaaccgggtaaaccggggttacgggtaaccgggtaaccgtaacgttaacccggtaaccggtaacggttgggaaccggttcctacgggacccttacccgtaagttttcccgttacggttccctttaaccgttcccgttaccccgttccccgg

SEQ ID NO: 177270 - DNA, 813 bp, Homo sapiens
  misc_feature: GYAE6OF02F5Y6R.14.86.H09.1.454.CMB.1.raw
  modified_base (199)..(200): a, c, t, g, unknown or other
  misc_feature (199)..(200): n is a, c, g, or t
tcagcgtctagtaccacgaccggtgctcgatttagtgctatagacttgggtttgggggaggaactgctcagttaggacccagagggaccatggcagccccagctcagcttctcttcctcctgctactctggctcccagatactcgaccggagaaattgtgttgacacagtctccactcaccctgtcttgctcagggaannccacctctcctgcacgggccagtcagtagtgtacaacaacctaacgttacgaccttaggtttaccagtacgaacgaaaccggtccgttacgggaccgacgggtacctaccccgtaagggtcccctacctttaccgaacgttggtaaggttccggtaaagttcggacctttaaaccgtccccgtaacgaacccgggggaccccaacccgggtactaaccccttaccccggaacggttacccgtaacgggtttcgaaacggtttccggggaacgtccggggtaccgggtttaccgggtaagggtaaccgtacggttacccggtctaacccctttaccggaaccgaccctaacgtaccgtacgtaccgaacgtaccggttaacgtacggttacgttaacgtaacgtttacggtttacggtacgttttaacgtttaacgtttacggttacgttacgtacgtacggtaacgggtacgggtacgtacggttccggtaccgtcgttaccggtacggtttaccgggacgggtaacgtacgggtacggtacgtacgaaacgtgtacggtaggtaccgtacgtaccgtactacgttccttacgttacttacgtacttacccgg

SEQ ID NO: 177271 - DNA, 712 bp, Homo sapiens
  misc_feature: GYAE6OF02GFGC4.14.86.H09.1.454.CMB.1.raw
  modified_base (181)..(181): a, c, t, g, unknown or other
  misc_feature (181)..(181): n is a, c, g, or t
  modified_base (386)..(386): a, c, t, g, unknown or other
  misc_feature (386)..(386): n is a, c, g, or t
  modified_base (442)..(442): a, c, t, g, unknown or other
  misc_feature (442)..(442): n is a, c, g, or t
tcagcgtctagtaccacgaccggtgctcgatttagtgctatagacttggggtttgggggaggaactgctcagtttaggacccagagggaaccatggcagccccagctcagcttctcttcctcctgctactctgctcccagatatcaccggagaaattgtgttcgacacagtcctcacgccnccctgttctttgtactccgaaggggaacgcgcccacccttctccgtgcgacgggccagtccgagtagttcgttacgcctaaccttccgttagcccgtaggtaacccaacgaacgtaaaccgtcggcccgacggtcccgtacccgtacggccctacctcactcttctgtatcgtctaccaacggacggccacgtcgctactcccgngtccgtacggtcaggttcggacgtagggtcggtcgtagggacctacgtacttaccncgttactaccgtactactacgacctacccgttcgtaacggtcgtccgtaggttaacgtttagttttagttacgttttaagttcgttacgttcgtacgtacgttagtacttacggcgtagtacggttccggtacccttaccgttacgggttccgggaacgggtcgggttaaccgggacgtacgggaacgttacgtaccgaacggtacgttcggtccggtctaccgaccgtacgtacgttcttacggttccttaccgtcgttcccgtacccg

SEQ ID NO: 177272 - DNA, 740 bp, Homo sapiens
  misc_feature: GYAE6OF02ICZ93.14.86.H09.1.454.CMB.1.raw
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
tcagcgtctagtaccacgaccggtgctcgatttagtgctatagacttggggtttgggggaggaactgctcagttaggacccagagggaaccatggcagccccagctcagcttctcttcctcctgctactctggctccagatatcaccggagaaattgtgttgacacagtctccacgccctaccctgttctttgtcctccgaaggggaanacgcccaccctctcctgcgacgggcagtcagtgttgttacncctacctcttacgccgtcggtaaccaacgacgaaaccgtcggaccgacggtccctacccgacgtccccttccctactactccttacgttgtactcgtaccgttaaccgaacggccggacctacgtcggacctacctcccgaacgtaccgttaggttaccgagggtcggtacggtcgggttacggggtacggacgggtaactacggttacttaccgtacctctaccgtacctacgtccgtaccgtaccctaccggtaacgtacgtccgttaaggtacgttttagttttacggttttaactttacgttacggttactaaccgtaggtactaaggtaacgtacgtacgtacgtcggttccgtccccgttacgttcgggttaccgggacgggtaaccgggaacggtaggtacgacgtacctacggtaacgtacgtcgggactcgtactaccgtacgtacttcggttaccttacgttacttacccgtcctacccg

SEQ ID NO: 177273 - DNA, 888 bp, Homo sapiens
  misc_feature: GYAE6OF02I54KH.14.86.H09.1.454.CMB.1.raw
  modified_base (277)..(277): a, c, t, g, unknown or other
  misc_feature (277)..(277): n is a, c, g, or t
  modified_base (601)..(601): a, c, t, g, unknown or other
  misc_feature (601)..(601): n is a, c, g, or t
  modified_base (616)..(616): a, c, t, g, unknown or other
  misc_feature (616)..(616): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatactcgaccggaagaaattgtagttgacctactacggtctccagccctaccctggttctttcgtcctaccgaaggggaaacacgtcccaccctccgtccgtcgacgtacgggaccagttacagtacgtacggttacncctacctcgttacgccgtacgtaccaacgtacgtaaacctcggaccgtaaggccttacccgaacgtccccgtcctcgtaacttcccgtcgtacgtacttccggaccctttaccgaaaccggtccggacctacgttcggaacctaccgacccctaacgtcccgtaggtaccgtacggacgtccgttaaggtcgggttaaccgcgggtaacctacggttccttaccggtaacgttaccgaacccgtcgtacgttacccgaacggttcccttaacccggtacggtaggtaccccgtaagggttacgtttaactttaaccggggtttnttaaaccccggtttnaaccccggtttataaaccgggttcgttaaacgtttaacgtaccgtacggaccgtttaaccggttcccggtaacccctttaccgttacggttacggggaacccggtttcgggtaaaaccgtacggggtacttaccgggtaacccttacccgtaaaccggggtaaccgttcgggttaacggtcccccgtttaaggggacccccttaaggttacccgttttaacccggtttcggtaaacccctttaacgtccccccggttttaaagccccccggg

SEQ ID NO: 177274 - DNA, 783 bp, Homo sapiens
  misc_feature: GYAE6OF02IH7AD.14.86.H09.1.454.CMB.1.raw
  modified_base (247)..(247): a, c, t, g, unknown or other
  misc_feature (247)..(247): n is a, c, g, or t
  modified_base (760)..(760): a, c, t, g, unknown or other
  misc_feature (760)..(760): n is a, c, g, or t
tcagcgtctagtaccacgaccggtgctcgatttagtgctatagacttgggtttgggggaggaactgctcagttaggacccagagggaaccatggcagccccagctcagcttctcttcctcctcgctactctcggctccagatatcaccgagaaatgtggttgacacagtctccagcctaccctgttcttttacggtctaccgtaaggggaaacgacgcctaaccctccttccgtcgcgacgggccgngtacgaggtacgttacgttaggcctacccgttaccgttacggcccttacggtacctaaaccgacgaaaccgttcggaccgacgtccgtacccgacgtcccctcctctactctctagaccttcgaccttaccgaaccgaccgggacccgtaacgtcggacctaccgttaccccgacgtacccgttaccggttaccggtacgggtacggcgttacggggttacgggtaccgttaacggggaacctacggttaaccgtcctttaccggtccctaacctacccgtacgtacctacggtaccttcccgtaacggtaacgtccggtaggtactttacgtttttagttaacgtttactttacttggtacggttactacgtaacgtttacgaccgtacgtacggtcgttccgtacccgtcccgtttacgtaccggggtaaccggagggtaccgtaacggtacgggacttaacgaccaacgtacgcggtaccgtcgaccgactacgtacgttcgtaccgttntaccggttacttccccgtaccgg

SEQ ID NO: 177275 - DNA, 770 bp, Homo sapiens
  misc_feature: GYAE6OF02GI3K9.14.86.H09.1.454.CMB.1.raw
  modified_base (232)..(232): a, c, t, g, unknown or other
  misc_feature (232)..(232): n is a, c, g, or t
  modified_base (582)..(582): a, c, t, g, unknown or other
  misc_feature (582)..(582): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagcccaccctgtctttgtctccgaggggaaagcgccacccttctcctgcgacgggaccngtcaggagtgttacgcctaccttccttacgccctggaacccaacgaacgaaacccgtcggaccacggccctaccccgaagtccccgttccctacacttccgttctacggtacttcggtaccgtttacccgaaccgtaccgggcccgtaccgtgggacccctacgacccgaccggtaccgtaaggggttccagggtacgccggtagggttccggggttgacgggaccgtacgtcgttaccacgttccgtaccacctacgtctaacgtcctaccgtacgacctcggttaggtacgtttagttttacggtttaacgtttactttacgacgtttacgagtaccgttaaggtacncggtactacggttccgtaccggtccccttaccggttacgggtttccgggaccggggtaaccgggtaaccggtagggtcggtaacgtaccggtaacccgtaaggtaccggttcgggtccggttaacctcggtaccctaacgttcgttcggtttaaccgtccgttttacccgtacctttccccggaaccc

SEQ ID NO: 177276 - DNA, 751 bp, Homo sapiens
  misc_feature: GYAE6OF02HDHCK.14.86.H09.1.454.CMB.1.raw
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatactcaccggagaaattgtcgttgacactagtcctcagccacctgtcttgtctcgagggaancnccacctctcctacgcacgggccagtcagtgttacgttacgcctaccttccttacgccttacggtaaccaacgaacgtaaacccgtggacccgaaggccctacccgacgtccccttcctctatcctctgactcgtccttaccgaacgcggtcccagtcggactaccncccgacgtccgtaacggttcaacgggtggacgtaagggtggtaccgtacgggaacctaggtacctttacgaccttacccgtaccaccgtaactccgtaccgtccctaaccgtcgaacgtccgtagggttaacgtttaagttttcgttaaacgtttacgttaccgtgttaccgtacttacgtagttaactacgtcgtacgttccgttccggtccccttacccgttaccgggttcgggaacgggtaaccgggtaaccgtaaagggtccgtaaacgtaccgtaaccgtaaaccggttaccgtacggccggttaccgacgtaccctaacccgttaggtttacccttaccgttttccgtacccgttaccgttcccccgttaaccgg

SEQ ID NO: 177277 - DNA, 724 bp, Homo sapiens
  misc_feature: GYAE6OF02HA6ZP.14.86.H09.1.454.CMB.1.raw
  modified_base (269)..(269): a, c, t, g, unknown or other
  misc_feature (269)..(269): n is a, c, g, or t
tcagcgtctagtaccacgaccggtgctcgatttagtgctatagacttgggtttgggggaggaactgctcagttaggacccagagggaaccatggcagccccagctcagcttctcttcctcctgctactctggctcccagatatcacggagaaattgtgttgacacagtctccagccaccctgtctttgtctccgaaggggaacgagcccaccctctcctgacacggccagtcaggtagtgttagcctacctccttagcctggtaccaanagaaacctcggaccagggcctccagcctcctcatctactgatcgaccttaccaacgtacgggcctacgtggacaccgtcccacgaccgtggttacgtaggcggaccagggtcgggttcgaggggtactaggtacctttcacctctacacctaaggtcccagtaccccgtaccgtacgtcgtcgtacggtacgtttagtttacgtttactttatttacgttgtacgtagtacgtagtactcgtacgtagtcgtacgtaccgtaccgttaccgttaccggttaccggggttaacgggaaccgggtaaccgggtaacgggtaacggtaacggtaacccgtaaggtaaccccccccggttaagggtaacggttccgggtaaccgtacccggtaccgttaccgttaccggtttaccggttaccgtttacccgtttacccgtttaacccgtttacccccgg

SEQ ID NO: 177278 - DNA, 688 bp, Homo sapiens
  misc_feature: GYAE6OF01EFEII.14.14.B03.1.454.CMB.1.raw
tcagcgtctagtaccacgaccggtgctcgatttagtgtgagtagtttgggctgagctgggtcttccttgttgctattataaaaggtgtccagtgtcaagtgcagttggtggagtctgggggagcttggtcaagcctggagggtccctgagactctcctgtgcagcctctggattcaccttcagtgactactacatgacctggatcccgcaggcgccgaggggaagggctggaatggattgcatacattcactatagtgaaatgcagtgtcctacgcagactctctagaagggccgattcaccgtctccgaggacaaccgacaaacgaacgtcgctgtactctagacaaatcggacgcctgagtacgtcgaggaccaacggcctagttcgtaattacgtggtcgacgtaggtagttggttcggttcggttctaagtttcgttttaagggtaaaggtttcggggttcttttcggaacccgtacggttcgggggacccgtaacggggtaaccccgttcgggtacccgtaacccggtttccgttcccgttaccgtaccggtccccttacccgtaacccggaaaccgggtccccgtaacggtttcccgggttacccccttcccccggtccggccctaacccccgtcccgttaacccgaacgaccgtacccgtacccgtccgggtacccggggg

SEQ ID NO: 177279 - DNA, 707 bp, Homo sapiens
  misc_feature: GYAE6OF01B5VQ9.14.14.B03.1.454.CMB.1.raw
  modified_base (282)..(282): a, c, t, g, unknown or other
  misc_feature (282)..(282): n is a, c, g, or t
  modified_base (593)..(593): a, c, t, g, unknown or other
  misc_feature (593)..(593): n is a, c, g, or t
tcagcgtctagtaccacgaccggtgctcgatttagtgtgagtagtttgggctgagctgggtcttccttgttgctattataaaaggtgtccagtgtcaagtgcagttggtggagtctgggggagcttggtcaagcctggagggtccctgagactctcctgtgcagcctctggattcaccttcagtgactactacatgacctggatccgccgaggccgccaggggaagggctggaatggattgcatacattcacttatagtaggaaatgacagtcgtcctacgnagactctcgtaggaacgggcctattccgaccgttccgtacccggaagggtaaccaaccgacccgtaaaacggaaccttccggacttacggtactccgtagaacaaacgtccggaacccggtcctaggacgtaacggtcggacggtaccgaccggactagttagtaacgtttaccgtggtcggacggtagggtaggttcggttacggtttcggtacttagtttagggttttaaggtagggtttcgggtacgttttacgaccgtacgggtcgggacgtacgggtacccgtcggtccgtccgttcttccttacnccgtaccctacccgaccggtacggaccccttacgtcccgttccccttccccgttccgcccgttaaccccctcccgtaaccgaacctacgcccgttaccgtccgggtaaccgggg

SEQ ID NO: 177280 - DNA, 590 bp, Homo sapiens
  misc_feature: GYAE6OF01BCXD1.14.14.B03.1.454.CMB.1.raw
tcagcgtctagtaccacgaccggtgctcgatttagtgtgagtagtttgggctgagctgggtcttccttgttgctattataaaaggtgtccagtgtcaagtgcagttggtggagtcgtgggggaggcttggtcaagcctgggagggtccctgagactctcctgtgcagcctctggattcaccttcagtgactactacatgacctggatccgccaggcgccaggggaaggggctggaatggattgcatacattcactatagtaggaaatgcagtgtcctacgcagactctcgtgaaggccgattccgaccgtctaccgaaggacaacgccaaagaacctcgctgtactctcgacaaagtccggaacggcctagacgagtcggagacgacgaccatacgtatactgtgagagtagtgtggttcgtatagttagtttagtaggtttgggtctttagtacgacgtcgggccgacgggtaaccgtcggtactaccgtctactcgacgcctccgacgtaccggcctacgtccgttcccttcccccgtcggccctaccccgtccgtaccgaacgacgtccgtaccgtcggtaccgggg

SEQ ID NO: 177281 - DNA, 810 bp, Homo sapiens
  misc_feature: GYAE6OF02JCI20.14.14.B03.1.454.CMB.1.raw
tcagcgtctagtaccacgaccggtgctcgatttagtgtgagtagtttgggctgagctgggtcttccttgttgctattataaaaggtgtccagtgtcaagtgcagttggtggagtctgggggagcttggtcaagcctgggagggtccctgagactctcctgtgcagcctctggattcaccttcagtcgactactacatgacctggatccgccaggcgccagggaagggctggatggattgcatacattcaactatagtaggaaatgctaggtgtcctaacgtcgaagtacctctcgtacggaagggcccgtattccgtaaccgttccgtaccgaacggggaaccaaccggtaacccaaacggtaacctccggtacgttacgtaacgttctagacctaaagttccgggaacgtccttagaacggtacgtacggaacggaccgtaaccgggcctaagttcgtaacgtttacgtacggttagaccggtaaggtacggttcggtacggtttcgggtagttacggttttagggttttaacggttaacggggttttgggggttaccgtttttacgggaacccgttacggggtacggggacccggggttaaccggggttaaacccccgttcgggtaacccgttacccggtttcccgttacccgtttaccgtaccggttaacccctacccgggtaaacccggtaccgggtaccccgttacggttccccgggtttccccttaaccccgggtccggtacccctaccccgttaccccgtaccgtaacggtaccgtacccgtacccggttcggggtacccggg

SEQ ID NO: 177282 - DNA, 696 bp, Homo sapiens
  misc_feature: GYAE6OF02JGOT2.14.14.B03.1.454.CMB.1.raw
  modified_base (287)..(287): a, c, t, g, unknown or other
  misc_feature (287)..(287): n is a, c, g, or t
tcagcgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacagtgacctggatccgccagggcgccagggtaagggctggaatggattgcatacagttcactataggtgaaattgcagttgtctacgcaggctntctaggagggccattcacgtctccgaggacaacgccaagactcgctgtatctgactaaatccgacgtcctgagtagccgagggtaccacgggaccctagtacgttaacgtttaactggtacggcggtaacggtacggttggttcgggttacggggttacctaggttttacgttttagggttaaaggtttcggggttacttttacggacctacgggttcggggaccgtaacggggaacccttggggaccctaccggttccgttaccttccgtaaccgtccccgtaccgaaccccgtaacgggtccccgtaacggttcccgttacccggttccccgttcgggacccctaacccccggttcccttaccggaaacggtacccggtacccgtacccggttccggtaacccgggg

SEQ ID NO: 177283 - DNA, 552 bp, Homo sapiens
  misc_feature: GYAE6OF01DSEFB.8.66.F11.1.454.CMB.1.raw
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (414)..(415): a, c, t, g, unknown or other
  misc_feature (414)..(415): n is a, c, g, or t
  modified_base (417)..(417): a, c, t, g, unknown or other
  misc_feature (417)..(417): n is a, c, g, or t
tcagctcgcgtgtccacgaccggtgctcgatttagtcacgcgagaagggggtctcagagaggagccttagccctggactccaaggccttccacagaggactcaccatggaattggggctgagcggtggtttcgtgtaggctatttagaaggtgtcagtgtgaggtgcagctggtggagtctggggggggcttagtccagcctggggactccctaaagctctcctgtgcagcctctgattcacctttggcaagtcttggatgggctgggtccgccaggctccgagggggggcgctgggagtggggtggccaacngtcaacggagatgcaaaggngacctatattggactctgtgacgggccattcaccatctcaganacaacgccgtaacaactnactgtctctagctgatgacnncnctgagacgacgacgacgacgtactactacttacttacgtagtacgacgacgtactctctacttccgttactatactacgtagtacggtcgggaccggacggtaccggtcggttcgtccgtccgtccgtcgtaccg

SEQ ID NO: 177284 - DNA, 689 bp, Homo sapiens
  misc_feature: GYAE6OF01DRV4Q.8.66.F11.1.454.CMB.1.raw
  modified_base (345)..(345): a, c, t, g, unknown or other
  misc_feature (345)..(345): n is a, c, g, or t
tcagctcgcgtgtccacgaccggtgctcgatttagtcacgcgagaagggggtctcagagaggagccttagccctggactccaaggccttccacagaggactcaccatggaattggggctgagctgggttttccttgttgctattttagaggtgtccagtgtgaggtgcagctggtggagtcgtggggggggcttagtccagccgtggggacctccctaagacctctcctgtgcagcctctggtattcctacctttggactaagttcgttggagtgggccgttcggggtcccgaccgaggccgtccgggagggggggccgcgtgggaggtcggggtcggacccaanacgtacgaaacggacgagtacggacgaaagggactaccgttaattaagtttcgggaacttcgtggtagggacgggtccgtacttccaacctactcctccgaagaacggaaccgaaaccgcccgaaactaacctcccgtaacgttcgtccttcgtgtcgttagatggtacgcgacgaccgtgacgacggcccgaacggacacggtaccttaactcttaagttaccgtgtcggtacgaacgtcttacctcttaccgtttcctacgtacttcgtagtaacgtccggacggggtacccggtaacgtacccggttcggttacccgttccgtccctccgtccgtaccccg

SEQ ID NO: 177285 - DNA, 876 bp, Homo sapiens
  misc_feature: GYAE6OF01B080Z.8.66.F11.1.454.CMB.1.raw
  modified_base (295)..(295): a, c, t, g, unknown or other
  misc_feature (295)..(295): n is a, c, g, or t
tcagctcgcgtgtccacgaccggtgctcgatttagtcacgcgagaaggggtctcagagaggagccttagccctggactccaaggccttccacagaggactcaccatggaattgggctgagctggtttccttgttgctatttagagtgtccagtgtgaggtgcagtcgtggtggagtcggtgggggggtcttaggtccaggccgtgggacctcccgtaagactcgtccgtagtgcagtcctcgttggtacttccgacgtttggacctaagtcgttggagtgggtcttcgggtaccnccgtacggtcgtaccgggagggggccgtcggtagggtacggtcggggtccggaccgtaacgcttaccggaaacggacggtaagttcgaaccggaaaacggtcgaacccgtttaacgtttagtttacggtaaccttcgtaggttacgggaacggggtactaacgtttacccgaccgtaacgttcccgtaacgaacgtaacgaaacccgacggaaccgtaacctacgtacccacggttacgttctaccgtaggttactacggtaacgtccggttaaacgaccctaacgggtccgtaagaaccgggtacggaaccccggaaaccgtacggaaccggttaccctttaagttaaccccgtttagggttaaccgttacggggtaccgtaacggtaaacgttccgttaaccgttacgttaccggttttaacccgttacccgtaaagttaccccggtttaaacggtaaaccgtttcccggggtaccgggggttacccccgtaaaaacgggggtttcccccggttaacggtttcccccgggttaaccggtttttccccctaacccggtaaccggtttaacccccccgggg

SEQ ID NO: 177286 - DNA, 531 bp, Homo sapiens
  misc_feature: GYAE6OF02J2G8O.8.66.F11.1.454.CMB.1.raw
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (528)..(528): a, c, t, g, unknown or other
  misc_feature (528)..(528): n is a, c, g, or t
tcagctcgcgtgtccacgaccggtgctcgatttagtcacgcgagaagggggtcgtcagagaggagccttagccctggactccaaggccttccacagaggactcaccatggaattggggctgagctgggttttccttgttgctattttagaaggtgtccagtgtgaggtgcagctggtggagtcgtggggggggcttaggtccagcctggggactccctaagactctcctgtgcagcctctggattcacctttggcaagtcttggatgggctgggtccncaggctcgaggggggcgcgtggagtgggtgccaanatcaacgacgatgacaaaggngacctatattggactnggtgacgggcattcaccatctaccagacacaacgccgaacaactcactgtctctgctgatgacgcacgctgacgacgccgacgacacggctatctatcgtgtacgcgtacncttcntacttccgtnagttcaggtactcggtacgggcgacgggtaccctgggtcctcgtcctcctanccg

SEQ ID NO: 177287 - DNA, 791 bp, Homo sapiens
  misc_feature: GYAE6OF02HZ5EZ.8.66.F11.1.454.CMB.1.raw
tcagctcgcgtgtccacgaccggtgctcgatttagtcacgcgagaagggggtctcagagaggagccttagccctggactccaaggccttccacagaggactcaccatggaattgggctgagctggtttctgttgctatttagaagtgtctagtgtgaggtgcagctggtggagtcgtggggggggcttaggtccagccgtggggactcccgtaagctctcctgtgcagcctcgtggacttctaccgtttggcctaaggttcgttgggattggggcgtcgggggtccgaccgaggccgtccggaggggggcgcgtggggaggttgggggtacgacccgaaacgaacgtaccgaaacgacgtagtcgaaaccgaaagggtaccgtaaaccgttaactttaggttacggaccttggtaggtacgggaaccgggcctagttaccacgtacttaccgacgaagacgaaacgacccgaaccgaaactactacccgacgttcgtaccgttcggtctacgtagaacgttacggacgtaacccgacgggtacctaggggaaaaccggtccggaacccgggaaccgtaaacggccggttaacttttactttaaccgttacgtggtaccgggaacgtaagtcccgtttacaccgttaaccgttttcccgtaacctagttcgttaaacgaaacggttttaccggggacccgggggtaacccggtaaaaccggggttcccgttacccggggttcggttaaccccgttttaaccccggtcccttacccgaaccccggttaccccg

SEQ ID NO: 177288 - DNA, 601 bp, Homo sapiens
  misc_feature: GYAE6OF02H26P0.8.66.F11.1.454.CMB.1.raw
  modified_base (359)..(359): a, c, t, g, unknown or other
  misc_feature (359)..(359): n is a, c, g, or t
tcagctcgcgtgtccacgaccggtgctcgatttagtcacgcgagaaggggggtctcagagaggagccttagccctggactccaaggccttccacagaggactcaccatggaattggggctgagctgggtttccttgttgctattttagaaggtgtccagtgtgaggtgcagctggtggagtcgtgggggggggcttagtccagcctggggactccctaagactctcctgtgcagcctctggattcacctttggcaagtcttggatgggctgggtccgccaggctccgaggggggcggctgggagtgggtggccaacatcaacggacgatgacaaaggagacctactatttggactctgngagggccattcacatctccagagacaacgccaacactcactgtctctcgctgatgagcacgcctagacgcgacccggacgacgacggccttatacttaacttactgtacggacgtaacgcctactactacgttttcccttctaattcccgtaagtaaaccgttacggtacgggggaccctaaccgggggtaaccccgtttggggttacccgttccgttcccgttcccgttaccgtaccccgg

SEQ ID NO: 177289 - DNA, 416 bp, Homo sapiens
  misc_feature: GYAE6OF01CM52M.48.9.A09.1.454.CMB.1.raw
  modified_base (411)..(416): a, c, t, g, unknown or other
  misc_feature (411)..(416): n is a, c, g, or t
tcagagtatacatacacgaccggtgctcgatttagcgagacgcgcaggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtcttccccctggcgccctgctccaggagcacctctgggggcacagcggccctgggctgcctggtcaaggactacttcctatgtatactctgagcgggctggcaaggcgcatagnnnnnn

SEQ ID NO: 177290 - DNA, 317 bp, Homo sapiens
  misc_feature: GYAE6OF01DNB3Q.48.9.A09.1.454.CMB.1.raw
  modified_base (314)..(317): a, c, t, g, unknown or other
  misc_feature (314)..(317): n is a, c, g, or t
tcagagtatacatacacgaccggtgctcgatttagcgagacgcgcagggacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnnnn

SEQ ID NO: 177291 - DNA, 161 bp, Homo sapiens
  misc_feature: GYAE6OF01CIFG3.48.9.A09.1.454.CMB.1.raw
  modified_base (160)..(161): a, c, t, g, unknown or other
  misc_feature (160)..(161): n is a, c, g, or t
tcagagtatacatacacgaccggtgctcgatttagcgagacgcgcagggcacgaccggtgctcgatttagtcacgcgagaaagggaaggggctggccctgacgtgtttctgttcccgcctcctctatgtatactctgagcgggctggcaaggcgcatagnn

SEQ ID NO: 177292 - DNA, 159 bp, Homo sapiens
  misc_feature: GYAE6OF01ATBNK.48.9.A09.1.454.CMB.1.raw
  modified_base (159)..(159): a, c, t, g, unknown or other
  misc_feature (159)..(159): n is a, c, g, or t
tcagagtatacatacacgaccggtgctcgatttagcgagacgcgcagggcacgaccggtgctcgatttagtcacgcgagaagggaaggggctggccctgacgtgtttctgttcccacctcctctatgtatactctgagcgggctggcaaggcgcatagn

SEQ ID NO: 177293 - DNA, 317 bp, Homo sapiens
  misc_feature: GYAE6OF01EKUBF.48.9.A09.1.454.CMB.1.raw
  modified_base (313)..(317): a, c, t, g, unknown or other
  misc_feature (313)..(317): n is a, c, g, or t
tcagagtatacatacacgaccggtgctcgatttagcgagacgcgcagggcacgaccggtgctcgatttagctctacgctcagggcacgaccggtgctcgatttagacgcgatcgaagggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccgccctcctcatgtatactctgagcgggctggcaaggcgcatagnnnnn

SEQ ID NO: 177294 - DNA, 316 bp, Homo sapiens
  misc_feature: GYAE6OF01DBD84.48.9.A09.1.454.CMB.1.raw
  modified_base (315)..(316): a, c, t, g, unknown or other
  misc_feature (315)..(316): n is a, c, g, or t
tcagagtatacatacacgaccggtgctcgatttagcgagacgcgcagggacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 177295 - DNA, 552 bp, Homo sapiens
  misc_feature: GYAE6OF01CK7YT.48.9.A09.1.454.CMB.1.raw
  modified_base (205)..(205): a, c, t, g, unknown or other
  misc_feature (205)..(205): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccaggtgaaaagngccaccctctcctgcagggccagtgagacagttactgttaattatttggcctggtaccagcagaagcctggccaggctcccaggcctcctcatctctgctgcatcctacacgggccactggcatcccagacaggttcagtggcagtgggtctggggacagacttcactctctccatcagcagactggacgccgtagaagtattttgactaatttattactgtactaactagtattggtacgtctacctaccttacgttacgtttcgggacgggtacggaccgtaagggtcgggagtagtacgaaaacggtacgtacggtcggacttcggacctaaccgatcgttacg

SEQ ID NO: 177296 - DNA, 506 bp, Homo sapiens
  misc_feature: GYAE6OF01CZ85F.48.9.A09.1.454.CMB.1.raw
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccagggactggtgaagccttcggagacccctgtcccctcacgtgcactgtctctggtgactccatcaacaatagtcattactactggggctggatccgccagtccccagggagggctggagtggattggattatctattatagcgggagcacctactatatccgtccctacaagagtcgagtcaccatatcgtagacacatccaagaaccagttcctccctgacgctgacgccctgtcgaccgccgcacgacacggctgtctattcngtcgcaccctncgatatcatgacgtggttgtacggg

SEQ ID NO: 177297 - DNA, 545 bp, Homo sapiens
  misc_feature: GYAE6OF01ESKK5.48.9.A09.1.454.CMB.1.raw
  modified_base (203)..(203): a, c, t, g, unknown or other
  misc_feature (203)..(203): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccaggctcccaggctcctcatctctgctgcatcctacacgggccactggcactcccagacaggttcagtggcaggtcgggtctggggacagtacttcactctctccatcagcagactggacgcctagaagtatttgacttaatttattactgtacactagtatggtagctactaccttacttaacgttccggcggtacgggtaccgtaagggtggaagacgtaagaaaccggtacgtggtggacttcggaccaaccgcttcgtcgttacc

SEQ ID NO: 177298 - DNA, 283 bp, Homo sapiens
  misc_feature: GYAE6OF01BQRM4.48.9.A09.1.454.CMB.1.raw
  modified_base (280)..(283): a, c, t, g, unknown or other
  misc_feature (280)..(283): n is a, c, g, or t
tcagagtatacatacacgaccggtgctcgatttagcgagacgcgcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctcgttcccgccctcctctatgtatactctgagcggctggcaaggcgcatagnnnn

SEQ ID NO: 177299 - DNA, 428 bp, Homo sapiens
  misc_feature: GYAE6OF01COGDY.48.9.A09.1.454.CMB.1.raw
  modified_base (243)..(243): a, c, t, g, unknown or other
  misc_feature (243)..(243): n is a, c, g, or t
  modified_base (424)..(428): a, c, t, g, unknown or other
  misc_feature (424)..(428): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctntggttagaccttcaccgccgactccagactctggcttccaccaagggcccatcggtccttccccctggccgccctgctccgaggacgcacctcgtgggggcacgacgccggcccgtgggctcggcctggtcaaggactacttcctatgtatactctgagcgggctggcaaggcgcagtagnnnnn

SEQ ID NO: 177300 - DNA, 447 bp, Homo sapiens
  misc_feature: GYAE6OF01EUBF7.48.9.A09.1.454.CMB.1.raw
  modified_base (439)..(447): a, c, t, g, unknown or other
  misc_feature (439)..(447): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccagggcccatccggtccttcccccgtggccgccctgcctccgaggacgccacctcgtgggggccacgacggccggccctggggcctggccctggtcgaacggactacgttcctatgtactactctgacgcgggctgggctaagggccacagtagnnnnnnnnn

SEQ ID NO: 177301 - DNA, 544 bp, Homo sapiens
  misc_feature: GYAE6OF01EBVKY.48.9.A09.1.454.CMB.1.raw
  modified_base (353)..(353): a, c, t, g, unknown or other
  misc_feature (353)..(353): n is a, c, g, or t
  modified_base (513)..(513): a, c, t, g, unknown or other
  misc_feature (513)..(513): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactacgtggggctggatccgccacgtccccgagggaagggctggagtggattggaattatctattatagcggancaacctactataactcccgtacctacaagacgtcgagtccaacctatactccgtagaccacactaccgaaagtaaccctagttccctccctaggacggtctaggacgccctagtcgacccgccgacacgacacggctcgtctattactgtcgcgaccctncgtatactctatagtacttgggttgtacggg

SEQ ID NO: 177302 - DNA, 497 bp, Homo sapiens
  misc_feature: GYAE6OF01ARD5J.48.9.A09.1.454.CMB.1.raw
  modified_base (478)..(497): a, c, t, g, unknown or other
  misc_feature (478)..(497): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggacgccccactgccaggtgcacggtggggcagtcgtggggctgaagtgaaggacggccgtggggcctcgagtgaaggtctcctgcaaggtcctctggttacgaccttcaccgccgactccagactctcggtccttccaccgaacgggcccatccggtcccttccccgtggccgccctgcctccgaggtacgccacccgtcgtcggggggcacgacggcccggcccgtggggcctcggccgtcgggtaccaacgggtaccttaccttccctcttacctccgtactcctggacggcgggcgtggacgaacggcgcagtacgnnnnnnnnnnnnnnnnnnnn

SEQ ID NO: 177303 - DNA, 746 bp, Homo sapiens
  misc_feature: GYAE6OF01AUBQW.48.9.A09.1.454.CMB.1.raw
  modified_base (205)..(205): a, c, t, g, unknown or other
  misc_feature (205)..(205): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggcctcccagataccaccggagaaattgtgttgacgcagtctccaggcaccctgtctttgtctccgaggggaaancgccaccctctcctgcgacgggccagtgagactagttactgtttaattgtttcggcctggtaccagcagaacgcctggccaggcctcccgaggcctcctcactctctgctcgctactcctacgcgggcctacgtggccactccgagtaccgtaggttcaggtcgggacgtagggttcgggtcgtacgggaacctacgtaccctttccgaacctttccgtaccttaccctacgtaccgaacggtcgtaacgggtaccggtacgggtaaccgttaccggtaaggtaaacggtttacgtttttacggaaaccttttaaagtttttacttaaccggttacgttaccaaccgttaacggttagttaccggttacgtacccttaacccgtaaccctttacggtttaacccgggttacgggaacgggtaaaccgggtaacccggttaaaggggtacggtaaacggtaaccgttaaaccggaaacgggttaccgttgggtacggtacccgttacggacccttaaccgtagtttcccgttcgttaacccg

SEQ ID NO: 177304 - DNA, 523 bp, Homo sapiens
  misc_feature: GYAE6OF01B3Q5E.48.9.A09.1.454.CMB.1.raw
  modified_base (376)..(376): a, c, t, g, unknown or other
  misc_feature (376)..(376): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctgatgactccatcaacaatagtcattactactggggctggatccgccagtccccgagggaagggctgggagtggattggaattatctattatagcgggagctactactatactccgtccctanagagtcgatcacatactccgtagacacactccaaagtaaccagtttcctcccgtgacggctgacgtccctgtcgacccgccgcacgacgacggtctagtctattacgtgtagccgaccatacgatactcagtcgtgttggttacggg

SEQ ID NO: 177305 - DNA, 562 bp, Homo sapiens
  misc_feature: GYAE6OF01EHE0E.48.9.A09.1.454.CMB.1.raw
  modified_base (240)..(240): a, c, t, g, unknown or other
  misc_feature (240)..(240): n is a, c, g, or t
  modified_base (532)..(532): a, c, t, g, unknown or other
  misc_feature (532)..(532): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggacgaccctgtccctnacgtgcactgtctctggtgactccatcaacaatagtcattactacgtggggctggactccgccacgtccccgaggggaacgggctggagtggattaggaattatctattagtaggcgggagcacctactaataactcccgtccctacaagagtcgagtcaacctatactaccgtagaccacaactaccaacgaaccctagttcctccctaggacggtctcgacgtcccgtggtaccgacccgtccgaccacgaccgacggccttgtacttacttacgtggtcgccgaccctntacgatactcatgtacgttggttgtacggg

SEQ ID NO: 177306 - DNA, 731 bp, Homo sapiens
  misc_feature: GYAE6OF01DKADB.48.9.A09.1.454.CMB.1.raw
  modified_base (202)..(202): a, c, t, g, unknown or other
  misc_feature (202)..(202): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctcaggcaccctgtctttgtctccgaggggaanagccacctctcctgcagggccagtgagactagttactgtttaattattggccttggtaccagcagaacgcctggccaggcctcccgaggcctcctacacttctctgtctcgctactccgtacgacggcctacgtcggactacgtcccgaagtaccgtaggttcgaggtcggacgttacgggtcgggtacgtacggggaactacgtacccttacgtaccttcgttccctacctacgtcgagaccgtaggtaccgtacgggacgtaccgttaggtaacgtttacgttttaggaacctttaagtttttacgttaccgttacggttaacctaaccgttaggtttaacgttacggttaccggttacccttaacccgttaaccgtttaaccgtttaaccgggtttaccggggaaccgggttaacggggtaaccgtaagggggttaacgtaacggtaacgttaaaccggaaacggttacggttaccgggtaggccgttaaccgtaccgtaaccttcggttccgttcggtttacccg

SEQ ID NO: 177307 - DNA, 698 bp, Homo sapiens
  misc_feature: GYAE6OF01EU2XU.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctctgctggtggcgctccagatgggtcctgtcccaggtgcagctgcagggagtccgggcccaggactgggtagaacgtcccgtttcgggacgtaccccttggtcccctcgaccggtgcctacgttgtcctcgtggtcgacctccataccaactaatagtactattacgtacgtggggctggtactcccgccgacgtcccgaggggacgggcgtgggagtggtagttaggtaattatacttaagttagtaggacggagtacctaaccttaactaacttaacgtcccgtaccctaacgtaacggtacgttacgtacgtaccaacctaagtaccgttaccgtaagaaccaactactaaccgaaacgtaacctacgttaccctacccgtaggtaccggtctacggaaccgtcccgttacggtacccggaccccggtccgacgacgacccgtaccggtccgttacgttaccttacgttacgtacggtccgaacccggtacctacgtacgtaacttacgtacgtacgttacgtacggtttgggttacgggttaacccgggg

SEQ ID NO: 177308 - DNA, 334 bp, Homo sapiens
  misc_feature: GYAE6OF01AT3QN.48.9.A09.1.454.CMB.1.raw
  modified_base (326)..(334): a, c, t, g, unknown or other
  misc_feature (326)..(334): n is a, c, g, or t
tcagagtatacatacacgaccggtgctcgatttagcgagacgcgcagggacgaccggtgctcgatttagctctacgctcagggcacgaccggtgctcgatttagatcgtctgtgttgggtttggggggtgtggtggtctccactcccgccttgacgaggctgattactactgtcagtcttttgataacaacaatccacgtggtcttcggcggagggaccagcctgaccgtcctaggtcagccccaaggctgccccctggtcactctgttccccgcccctcctctatgtactactctgacggcgggctggacaagggccgacatagnnnnnnnnn

SEQ ID NO: 177309 - DNA, 553 bp, Homo sapiens
  misc_feature: GYAE6OF01C0UBE.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtcccctcacgtgcactgtctctggtgactccatcaacaatagtcattactacgtggggctggactccgccacgtccccgagggaaggggctgggagtggattggaattatctattataggcggagcacctactaatactccgtcctcaagagtcgagtcacaatactccgtagacacactacccaagaacctacgttcctccctagacggctacgacgccctggtacgacccggccgacgacgaccgacggcttgtaccttacgttactggtcgaccgacccattccgattactcaatgtaacgttgggttggtaacggg

SEQ ID NO: 177310 - DNA, 506 bp, Homo sapiens
  misc_feature: GYAE6OF01DI7UI.48.9.A09.1.454.CMB.1.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
  modified_base (485)..(506): a, c, t, g, unknown or other
  misc_feature (485)..(506): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacggtggggcagtcgtggggctgaagtgaagaggcctggggcctnagtgaggtctctgcagtcctntggttagaccttcaccgccgactccagactctggccttccaccaggcccatccggtccttcccccgtggccgccctcgcctccagggtacgcctacctcgtaggggggccacgacggccggccccgtggggcctcggtccgtgggtaccgaagggtccttacctttcccttcctccttccgaccttccgtggacggtccggggccgttcggggacgtaacgggcccgacgaacgttaggctgnnnnnnnnnnnnnnnnnnnnnn

SEQ ID NO: 177311 - DNA, 561 bp, Homo sapiens
  misc_feature: GYAE6OF01CB3FC.48.9.A09.1.454.CMB.1.raw
  modified_base (382)..(382): a, c, t, g, unknown or other
  misc_feature (382)..(382): n is a, c, g, or t
  modified_base (506)..(506): a, c, t, g, unknown or other
  misc_feature (506)..(506): n is a, c, g, or t
  modified_base (533)..(533): a, c, t, g, unknown or other
  misc_feature (533)..(533): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctctgctggtggcggctcccagatggggtcctgtcccaggtgcagctgcaggagtccgggcccagggactgggtgaacgtcccgttcgggacgtaccccttggtcccctcgaccggtgcctactgtctcgtggtcgactccatacaacaatagtcattactacgtggggctggactccgccacgtaccccgaggggaacggggctgggagtggattaggaattatctatataggcgganctacctactataactcccgtcctacaagagtcgactcaccatactccgtagaccactactaccaacgaacctagttccaccgtgacgctacgacgtcccgtgtccgacccgtccgcacggaccncggctgtctactacgtgtcacgacctntcatactcatagcgttggttggtacggg

SEQ ID NO: 177312 - DNA, 689 bp, Homo sapiens
  misc_feature: GYAE6OF01B6V4B.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccagctgcagctgcaggagtcgggcccaggactgggtagaacgccgtttcgggagacccctgtcccctcacctgctactgtctcgtggtggcctccatcagcagctacgtacttacgttcgtgggctggactccgccacgccccgagggacgggctggagtggtagttaggggattacgttaaccgacgtaggtgggacgtaccaaccgtaacgtacccgaacccgtcctaacgaaacggtcgacggaccaacctaagtacgtaccgtaacgtaacctaaccgtaaccaaacgtaaccctaactttaccctacccgtagtaacgcgtacggtactccgttcgtacggtaccgacccggacccgtaccgacggaaccgtaccggtccgtttacgtaccctttaaaggttaccgtacggtaccgggaccggtacccgggacccccggtaggcccgtacggttaacggtttcggttccgttttttaaggacgtttccggtttccgtttaacggg

SEQ ID NO: 177313 - DNA, 658 bp, Homo sapiens
  misc_feature: GYAE6OF01BQF5M.48.9.A09.1.454.CMB.1.raw
tcagagtatacatacacgaccggtgctcgatttagcgagacgcgcgagggggaggcatcacccagcaacccacatctgtccctctagagaatcccctgagagctccgttcctcaccatggactggacctggagatcctcttcttggtggcagctagccgcaggagtcccactcgccaggtgcgacgtgggcagtctcggggctggaagtgaaggacggccgtgggggcctcgacgtgaaaggtcctcctgcaaggccgtctggttagaccttcaaccgccgactccagactctggcttcacaacggcccaatccggtacttccccctggcccgacccgtgccgtccgagggtacgccaaccgtcgtacgggggacacgaacggccggcccgtaggggccgtagcccgtacggtccaaacggggtaccttaaccgttcccgtaagttcggtaacttaccgttacttacggaacgtcccggggtccgttagggcctaaaacgggcccgtacgtaacgttaaaccgggagtacgacgtacgtacgtacgtacgtacgtacgtacgtacgtacgtacgtacgacgacgtacgtacgtacgtacgtagtacgtacgtacgtacgtcgtacgtacgtacgtacgtacgaccgacgtcgtcgtcg

SEQ ID NO: 177314 - DNA, 430 bp, Homo sapiens
  misc_feature: GYAE6OF01AXU6U.48.9.A09.1.454.CMB.1.raw
  modified_base (414)..(430): a, c, t, g, unknown or other
  misc_feature (414)..(430): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtcttccccctggcgccctgctccaggacgcaccgtctgggggcacagcggccctgggctgcctggtcaaggctacttcctctctcgactctgagcgggctggcaaggcgcagtagnnnnnnnnnnnnnnnnn

SEQ ID NO: 177315 - DNA, 537 bp, Homo sapiens
  misc_feature: GYAE6OF01EKLR5.48.9.A09.1.454.CMB.1.raw
  modified_base (386)..(386): a, c, t, g, unknown or other
  misc_feature (386)..(386): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagacccctgtccctcacgtgccactgtctctggtgactccatcaacaatagtcattactacgtggggctggactccgaccacggtccccgaggggaaggggctgggagtggtattggaattatctattagagcgggagcacctatataactccgtcctanaagcgtcgatcaccatactccgtagacactatacccaagaacctgttcctccgtgacgtctgacgtccctggtcgacccgccacgacgacacggctgtcttattctgtcgaccgacctgacgtatctacagtgtacgttgggttgtacggg

SEQ ID NO: 177316 - DNA, 883 bp, Homo sapiens
  misc_feature: GYAE6OF01C1VGN.48.9.A09.1.454.CMB.1.raw
  modified_base (819)..(819): a, c, t, g, unknown or other
  misc_feature (819)..(819): n is a, c, g, or t
  modified_base (837)..(837): a, c, t, g, unknown or other
  misc_feature (837)..(837): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaatgaagcacctgtggttcttcctcctgctggtggcgctcccagatgggtcctgtcccaggtgcagctgcagggacgtccgggcccagggactgggtacgaacgtcccgttacgggaacgtaccccttcggtcccccttcgaccggttcggacctaccttcggttccttccgttagggtctaccttacccaattaccaaaactaagttacgttacctaagtttaaccgtacggttcggggggtaccttacggtaccgttccccggacccgtaaccgggttaccccccggaagggggtaaacgggggtcgttaggggtaacggttagggtaaagtttagggtaaatttaacgttacgtttaagtttaacggtaacgggcggggtacgtaacctaacccgttaacgttaaacgttaacccgtttaccccgttaccccgttaacgtaaaccgggtacggttaccgggttaaccgttacccaaaccgttaaacgttaaccggttaaccccggttaaacggaaaccctaaacccgttaaaccgttaaacccccgtaaaaccggtaacccgtttacccggttttaaccccgtaccccggtttaggaaaccgggttcgtaccggtaacccgttcccggttacgggttacccggaccccgggtacccgacgaaccgtaccgacgtcttacgttactacgtttaccgngttacccgacctaccgtntacgtacttacgcgttaagtggttacggttgggttaggtaaccggg

SEQ ID NO: 177317 - DNA, 729 bp, Homo sapiens
  misc_feature: GYAE6OF01D0ZVZ.48.9.A09.1.454.CMB.1.raw
  modified_base (604)..(604): a, c, t, g, unknown or other
  misc_feature (604)..(604): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatcgggtcctgtcccaggtgcagctgcaggacgtccgggcccaggactgggtgaacgccctttacgggaacgtaccccttggtcccctcgacgttgcacgttgtcctcgtggtcgactccaatacaaacaatacgtctaatttacctacgtcgggggtcctaggaccttcccgaccgtaccggtaccccggaagggggaacggggcgttacgggtaggttgggtaagtttagggtaaaacttttaacgttaccttaaagtttaacggtacgggacgggggtaactaccctaaacccgttaacgttaacttaaaccgttaccccggttccccgttaacgaaacggtacgttacggtaacgttaccaaacccgtagttactacccggttaaagaaccaacctaacgtaaccctaaacgaaccttacgtttccctacccgnggtacggtctaggcgtcccgtagtcccgaccgccgtacacgacgacggtcttacgtcttaagttcctggtccgaccgtacctacgttaccgattacctcgattaggtacgttgggttggtacggg

SEQ ID NO: 177318 - DNA, 700 bp, Homo sapiens
  misc_feature: GYAE6OF01D8N9E.48.9.A09.1.454.CMB.1.raw
  modified_base (246)..(246): a, c, t, g, unknown or other
  misc_feature (246)..(246): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaacgtccttcgggacgacccctgtcccctnacggtgccactgtctcgtggtcgactccatacaaacaatagtcattactacgtggggctcggatccgccacgtcccgaggggagggctgggagtggagttggaattagtctattagtaggcgggagacctaaccttactaactaacgttccccgtccctacgtaagtaacggttccgaacgttaccaacccattaacgttacccggtaagacctaacactacccaaagaacccttacgttcccgtaccccgttaggacgggtaccttaggaccgtcccggttaggtaccgggaaccccggacccggtacgaaacggtacccgaccggggtacctttcggttaaccgtttaagtttacccgttgggttacccggtacccggttaaccctacgttaccggtaattaaccgtcgttaagtacgttaacggtttggggttttgggttaaacccggggg

SEQ ID NO: 177319 - DNA, 555 bp, Homo sapiens
  misc_feature: GYAE6OF01A98N8.48.9.A09.1.454.CMB.1.raw
  modified_base (368)..(368): a, c, t, g, unknown or other
  misc_feature (368)..(368): n is a, c, g, or t
  modified_base (422)..(422): a, c, t, g, unknown or other
  misc_feature (422)..(422): n is a, c, g, or t
  modified_base (518)..(518): a, c, t, g, unknown or other
  misc_feature (518)..(518): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaacgccttcgggagacccctgtcccctcacgtgccactgtctctggtgactccatcaacaatagtcattactacgtggggctggactccgccacggtccccgaggggaacgggctggagtggtattaggaattatctattagtaggcgggancacctactataacgtccgtccctacaagtagtcgagtccacctatactccgtanacacactaccaacgaacctgttccctcccgtggacggtctgacgccctggtacgcccgccgcacgacgacggctgtctatacgtgtcgccgacccntccgattactcagttgtacgttgggtttcggtacggg

SEQ ID NO: 177320 - DNA, 727 bp, Homo sapiens
  misc_feature: GYAE6OF01D2NNI.48.9.A09.1.454.CMB.1.raw
  modified_base (184)..(184): a, c, t, g, unknown or other
  misc_feature (184)..(184): n is a, c, g, or t
tcagagtatacatacacgaccggtgctcgatttagcgagacgcgcaggggcagggtgtacacctgtggttctcggggctgccctttggctttctgagagtcatggatcacatgtgacaagaaaatgaagcacctgtggttcttcctcctgctggtggcgctccagatgggtcctgtcccaggtncagctgcgagggacgtccggggcccagggactgggtagaacgtccgttcggacgtaccctcgtccccgtcacggtgcctacgttcgtcttcgtggtacgtacctccatacaaactaattacgtactattaccgtacggtggggtctaggtactacccgaccgtaccggtacccggaagggggacggtcgtggaggtggtagttaggtaattacgttacgtaagttagtacgggacgggataccgtaactacgttaataaccgttcccgtaccacgtaacgtacgttaccgtacgtacctaacctaagttaccgtcccggtaaagaacctacctaacttaacccgaaacgtaacccgttgtttacccctacccgtggacggtacctaggacccggtccctacgggtaccggacccgtaccggactaaggacccgtcggttcttacgttaccgtaactttacggtacgtccggtaacccaccgttagtaccggtaattaccgtacgtagttaccggttacggtttggggtttaacgggtaccggg

SEQ ID NO: 177321 - DNA, 641 bp, Homo sapiens
  misc_feature: GYAE6OF01AOK1I.48.9.A09.1.454.CMB.1.raw
  modified_base (203)..(203): a, c, t, g, unknown or other
  misc_feature (203)..(203): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgctccaggggaaagngccaccctctcctgcagggccagtgagacagttactgtttaattagtttggcctggtaccagcagaacgcctggccaggctccaggcctcctcatctctgctgcactcctacgacgggccacgtggcactccccagacctaggttcaggtggctagggtcgggtctggggaacagtaccttcaccttcctctacctatcgacgcacgtacgtgggacgtccgtagtaagtacttttacgtacttaattttacttacgttacgttaccaaccgttaaggttagttacgggtacgtccttacctacctttacgttaaccggtttccggggacgggtaacgggtaccgtaaaggggttacgggaacgtaacgtaacgaaacggtaccgttagggtacggtaccgttacggaccctaaacccgtcgttccgtttgttacccg

SEQ ID NO: 177322 - DNA, 630 bp, Homo sapiens
  misc_feature: GYAE6OF01CB7BB.48.9.A09.1.454.CMB.1.raw
  modified_base (462)..(462): a, c, t, g, unknown or other
  misc_feature (462)..(462): n is a, c, g, or t
  modified_base (581)..(581): a, c, t, g, unknown or other
  misc_feature (581)..(581): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctctgctggtggcggctcccagatgggtcctgtcccaggtgcagctgcgaggaggtccgggcccagggactgggtagaacgtccgttcgggacgacccctcgtcccctcacggtcgctacgttgtcctcgtggtcgactccatcaacaatagtctaattactacgtgggctcggactccgccgtacgtaccccggaggggaacgggcgtgggaggtggagttaggtaattagtacttaattagtacgggcgggacgtctaaccttactaactaactcccgtacctacgaagtacgtcgacgtcaaccatactaccgtanaccacactaccaagaacctacgttcctaccgtgacgtcgtacgtcgcccgtagtccgaccggtccgacgacgacgaccggcttacgtacttacgttacgtcggtccgaccgaacccgtnttacgtaagttactcctagttacggtacgtttggggttcgttaccgggg

SEQ ID NO: 177323 - DNA, 560 bp, Homo sapiens
  misc_feature: GYAE6OF01C8DL7.48.9.A09.1.454.CMB.1.raw
  modified_base (246)..(246): a, c, t, g, unknown or other
  misc_feature (246)..(246): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcagggagtcgggcccaggactgggtgaagtcccttgggacgacccctgtcccctnacgtgcactgtctctggtgactccatacaacaatagtcattactacgtggggctggactccgccacggtcccgagggagggctgggagtggattggaattatctattagtaggcggagacgtactactactaactcccgtacctagaagtagtacgagtcaacctatacgtaccgtagacacactaccaagaacctacgttcctccgtaggacgtactggacgtcctaggtcgaccgccgacacgacacggctgtactacttacgtgtcgacccgacctagtcgaatctactagtagtacgtggttggtacggg

SEQ ID NO: 177324 - DNA, 624 bp, Homo sapiens
  misc_feature: GYAE6OF01DM3FZ.48.9.A09.1.454.CMB.1.raw
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (596)..(599): a, c, t, g, unknown or other
  misc_feature (596)..(599): n is a, c, g, or t
  modified_base (601)..(602): a, c, t, g, unknown or other
  misc_feature (601)..(602): n is a, c, g, or t
  modified_base (604)..(607): a, c, t, g, unknown or other
  misc_feature (604)..(607): n is a, c, g, or t
  modified_base (611)..(616): a, c, t, g, unknown or other
  misc_feature (611)..(616): n is a, c, g, or t
  modified_base (618)..(618): a, c, t, g, unknown or other
  misc_feature (618)..(618): n is a, c, g, or t
  modified_base (620)..(624): a, c, t, g, unknown or other
  misc_feature (620)..(624): n is a, c, g, or t
tcagagtatacatacacgaccggtgctcgatttagcgagacgcgcagggggagcatcacccagcaaccacatctgtcctctagagaactcccctgagagctccgttcctcaccatggactggacctggaggatcctcttcttggtggcagcagccgcaggacgcccactgccgaggtgcgacggtggggcagtcgtggggctgaagtgaagaggccgtggggcctcgagtaggacggtctccgtgacgaaggtcctcgttcggttacgtaccctttcgaccgccgaactccgacggtacctcgtcggccttacccgaaccgaaccgggtcccaacgttcccggttccccgttcccccgtcgggtccgtccctacggccctcccgagggaccgcctacccggtcggtcggggggaccaaccggtacggcccgggtcccgtcggggtcctccggtccggtcgggtaaccgaacggttacctttacccgttcgttaattcgttacgtaaccgtccgttcggggaacgggtccgggtaccggtcgggtaaccggaacgggtccgaccgtaagttaacggcgangngncgagngcgngcgnnnncnncnnnngcgnnnnnncncnnnnn

SEQ ID NO: 177325 - DNA, 574 bp, Homo sapiens
  misc_feature: GYAE6OF01CDEC4.48.9.A09.1.454.CMB.1.raw
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtgttcttcctctgctggtggcggctcccagatgggtcctgtcccaggtgcagctgcaggagtcgggcccaggactggtgaagcccttcgggagaccctgtcccctcacgtgcactgtctctggtcgactccatcaacaatagtctattactacgtgggggctggactccggccacgtccccgaggggaacgggctgggagtggattggaattatctattagtgcgganctaactactagtaactccgtcctacgaagagtcgagtcaccatactcgtanacanacncgaanacctacgttctacccgtgacggctagacgtcccgtagtcgacccgtccgcaacggcacggtctacgttcttacgttacgtgtccgaccgtaaccccgtgtaccgtaattacgtcctaacgttggtaacgttgggtttacggttacgggg

SEQ ID NO: 177326 - DNA, 584 bp, Homo sapiens
  misc_feature: GYAE6OF01CRSHC.48.9.A09.1.454.CMB.1.raw
  modified_base (196)..(196): a, c, t, g, unknown or other
  misc_feature (196)..(196): n is a, c, g, or t
  modified_base (364)..(364): a, c, t, g, unknown or other
  misc_feature (364)..(364): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggngtcgggcccaggactggtgaacgtccgttcggacgacccctgtccctcgacgtgcactgtctcgtggtcgactccatacaaactatagtctattactacgtggggctggactccgccacgtcccgagggacgggctggagtggattggattatctatagtaggcgganctactactatacgtccgtacctagaagagtcgacgtcactatactaccgtagacacactaccaacgaacctcgttcctacccgtggacgtctacgacgtcccgtggtaccgacccgccgacgacgaccgacggtctgttactacgttcgcggtacgcccgtaaccctgtaccgtaacttactacgtaacgttcggtacgtttggggttggttaaccgggg

SEQ ID NO: 177327 - DNA, 781 bp, Homo sapiens
  misc_feature: GYAE6OF01EOR0Y.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctctgctggtggcgctccagatgggtcctgtcccaggtgcagctgcagggcgtccgggcccaggactgggtacgaacgtccgttacgggacgtaccccttcgttcccctagaccggttgacctacgttcggttccttccggttcgggtccgtacccttaccctaacttaaccaaactaaagttacgttacctaacgttttaaccgttacgggtcgggggtaccgttcgggtaaccgttccccggacccgtacccgggtaccccgggaaggggggtaacggggtccgttaggggtagggttacgggttaagtttaagggttaaactttacgttacgtttaagtttaacgtacggggtaccgggaagtaccctaaccgttaacttaacgttaaccgtcccgttacccgtaagtaacgtacggtacgtacgtaccaaccgtagtacgtaccgtacaacctaactactaacccgaagtaacctacgttccctcccgtaggacgtcgtacgtacccgtccgtagtacccggaccgccgtacggtacgaccgtacggtcttacgttacttacgttaccgtcggtaccaccgtaaccctgtacgtattacgtactagttacggttcggttggttcgggtaccggg

SEQ ID NO: 177328 - DNA, 823 bp, Homo sapiens
  misc_feature: GYAE6OF01B81ZP.48.9.A09.1.454.CMB.1.raw
  modified_base (94)..(94): a, c, t, g, unknown or other
  misc_feature (94)..(94): n is a, c, g, or t
  modified_base (143)..(143): a, c, t, g, unknown or other
  misc_feature (143)..(143): n is a, c, g, or t
tcagagtatacatacacgaccggtgctcgatttagcgagacgcgcaggggcagggtgtacacctgtggttctcggggctgccctttggctttcngagagtcagtggatcacatgtgacaagaaatgaagcactgtgttctccnctgctggtgcgctccagatgggtcctgtcccaggtgcagctgcgacggacgtcgggaccaggactgggtacgaacggtcccgttacgggaaccgtcccctcgtccccgtcgtaccggtcgaccttaccgttcgttccttcggttacggttaccgaccttacctaacgtaacctaaaaccttaagttacggttaccttaaacgttttaaccggtaacggttcgggggtacctacgggtaaccttccccggaccgtaccggttaccccgggaaggggtaacggggtccgtaggggtacggtaggtaagttaacgggtaatttacgtacttaagttacggtacggacgggtaactcctaacgttaacttaacgtaaccgttaccccggttaaccgtaaacggtaaacggtacggttaaccggtacgtaccgtaaaccgttaacgtacccgttaacggtaacccgaaacctaacgtaaacgtaaccccgtaaaacggtaaccccgtttaccggtttccccgtaacccggtaggtacccggttctaaccggtacccgtccctaacgggttccgaccccgtaccggaacgacggtacccgaggtcctagttaccttacgtccgtgaccgacctaccgtcgtaccgtaattacgtcgtaacttacggtcttacggggttgttaccgg

SEQ ID NO: 177329 - DNA, 296 bp, Homo sapiens
  misc_feature: GYAE6OF01DE8D6.48.9.A09.1.454.CMB.1.raw
  modified_base (95)..(95): a, c, t, g, unknown or other
  misc_feature (95)..(95): n is a, c, g, or t
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (276)..(296): a, c, t, g, unknown or other
  misc_feature (276)..(296): n is a, c, g, or t
tcagagtatacatacacgaccggtgctcgatttagcgagacgcgcagggcacgaccggtgctcgatttagatcgtctgtgttgggtttgggggtntggtggtctccactcccgcttgacgaggctgattactactgtcagtcttttgataacaacaatcacgtggtcttcggcggaggaccagcctgaccgtcctaggtcagcccaaggctgccccnggtcactctgtcccacctcctntatgtatactctgagtcggctggacaaggctcatagnnnnnnnnnnnnnnnnnnnnn

SEQ ID NO: 177330 - DNA, 689 bp, Homo sapiens
  misc_feature: GYAE6OF01DRP9S.48.9.A09.1.454.CMB.1.raw
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaatgaagcacctgtggttcttcctcctgctggtggcggctccagatgggtctgtccaggtgcagctgcaggagtcggcccaggactggtgaagccgttcggacgtaccctcgtccctcgacgtgccactgtctcgtggtcgactccatacaactaatagtctaattacgtacgtgggctggactccgcgacgtccgagggaggcnggagtgtatgtattatctatanaggcgganactaactataactactccgtacctagaagtgtcgaagtaccaccgtaattacgtaccgtaagacccaactaactacccgaaacggtaaccctacgtttacccgtcccgtaaggtcgtaccgtacggaccgtaccccgttcggtacccggaaccccgggtccgaccgtaaacgggaccgaccgggttaccgttagttttacccgtaaattttcccggtacgggttacccgaaccccggtaaccccttaacggtaacccgtttaaacgtttaccgttaccgtaaacggttcgggttaaccccggttttggggggttttaaacccggtaacgggggg

SEQ ID NO: 177331 - DNA, 763 bp, Homo sapiens
  misc_feature: GYAE6OF01BO074.48.9.A09.1.454.CMB.1.raw
  modified_base (186)..(186): a, c, t, g, unknown or other
  misc_feature (186)..(186): n is a, c, g, or t
tcagagtatacatacacgaccggtgctcgatttagcgagacgcgcaggggcagggtgtacacctgtggttctcggggctgccctttggctttctgagagtcatggatcacatgtgacaagaaaatgaagcacctgttgttcttcctcctgctggtggcggctccagagtgggtcctgtcccaggtncagctggcagggagtccgggcccaggacgtgggtagaacgtccgttacggacgtaccccgtcgttaccccgtcacggtgactacgttgtccttcgtggtcgtaccttctaattaccaaactaatacgttactaacgttacgtacggttcggggctacggtactcccgaccgtacggtcccggaaggggacggtcgtaggaggttagtacggttagtaattacgtacttagttacgtacgggacgggtataccctaacgttaacgtaacttaaccgttcccgtacccgttaacgaacggtacgttaccgaacgttacccgaaccttagttaaccgtacccgtaaagaacccttacaaccgtaaaccgtaaaccgtaacccgttaccgtttacccgtaacccggtggtaaccggcttaacgggaccccgttcccgtacgggttaacccggcccgtaccccgacgtaaccggaacccgtaggtccctaggtttacctacgtttccgacgaccggtaccctacccgtaagttccgtaagtacttaccgagttacgttacggtttcggggtagttacccggg

SEQ ID NO: 177332 - DNA, 583 bp, Homo sapiens
  misc_feature: GYAE6OF01CZPNP.48.9.A09.1.454.CMB.1.raw
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (424)..(424): a, c, t, g, unknown or other
  misc_feature (424)..(424): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtgttcttcctcctgctggtggcggctcccagatgggtcctgtcccaggtgcagctgcaggagtcgggcccagggactgggtgaacgccttcgggacgaccctgtcccctcacgtgctactgtctcgtggtcgactccatacaaacaatacgtactattacctacgtggggtctggactccgccacggtcccgagggaagggcgtggagtggattaggaattatctattanaggcggagcactactaatactccgtcctanaacgcgtacgacgtacactatactacgtanacgaactactaccaacgtaacctacgttccctccgtaggacgtctacggacgtcccgtacgtccgacccgtccgacacggaccgtacgtcttcgtacttagttcgtacgtcgaccgacctacgtacgtaatctactatcgtacgttggttcggtacggg

SEQ ID NO: 177333 - DNA, 528 bp, Homo sapiens
  misc_feature: GYAE6OF01BL50J.48.9.A09.1.454.CMB.1.raw
  modified_base (386)..(386): a, c, t, g, unknown or other
  misc_feature (386)..(386): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (511)..(528): a, c, t, g, unknown or other
  misc_feature (511)..(528): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcgttggtggcagcagccgcaggacgcccactgccagggtgcgacggtggggcaggtcgtggggctggaagtgaaggaggccgtggggcctcgaggtggaacggtcctccgtgcgaacggcccttgttggttacgtacccttccgacccggccgacctccagtaccgtctcggtccttaccgacccgaacgggcccctacgtcccggtcccttcccccgtggcccgtcccgtcgcctccgacggcgccnccgtcggtcggggcacgacggccggccgtcgggctcgccgtcggtacgtaacggtaccttacttcctagttcgtacttactcgtaggcggtcgggcgtaggacgaggcgactagtagnangnngnnnnnnnnnnnnnnnnnn

SEQ ID NO: 177334 - DNA, 823 bp, Homo sapiens
  misc_feature: GYAE6OF01C5F9U.48.9.A09.1.454.CMB.1.raw
tcagagtatacatacacgaccggtgctcgatttagcgagacgcgcaggggcagggtgtacacctgtggttctcgggctgccctttggctttctgagagtcatggatcacatgtgacaagaaatgaagcactgtgttcttcctctgcgtggtgcgctccgagagtcgggtcctgtcccgaggtcgcagcgtgacgagggacggtccgggaccgaggtacgtgggtacgaacgtcccgtttacggaccgtccccttcggtcccctacgtacggtcgtcctaccgttgttcctcggttacggtctaccctaccgtaataacctaaaacctagttacgtacttaacgtttaaccgtacggggtggggtacttacggtacctcccccggacgtacccgggtaccgggaagggggtacgggtcgtaggggtacggtagggttaattaggtaacttttactaaccgtttaagtttaaacgggaccggggaccgggtaactaaccttaaccgttaattaaccgttaaccgtcccgtaccgtaagaacgtcggtactaccgtactaacgtacgtacggtaaccgtaacgaacctaacgtaaccgtaaccgtaaacgttacccgttacgtttccccgacgtacgggaccggtctaaccgggtaccgttcccgtacggtaccccgggaacccgccgaaacggtacgaacccggttacggtcgttaaccgtttaccttcgttacccggttcggaaccgtacccccgtaattccgtaagttacgttaccgttacgtaagttaccgtttacggggtttgggttaacccggtaccggg

SEQ ID NO: 177335 - DNA, 775 bp, Homo sapiens
  misc_feature: GYAE6OF01AZ4VQ.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaatgaagcacctgtggttcttcctcctgctggtggcggctcccagatcgggtcctgtcccaggtgcagctgcgagggacgtccgggcccaggtacgtggtagaacgtccgttcgggacgtaccccgttcgtcccctcgaccgtcgcacgttcgttcctcgtggtcgacctccaatacaaactaattacgtctattaccgtcggtggggtctggactcccggccgaccggtcccggaaggggacgggcgtacgggaggtacggtaagtttgggtaatttagtacttaagttaacgtacgggtcgggacacccttaaccttaacgttaacttaaccgtacccgttaccccgtaagaaacgtacgttacgtaactccgtaaacctagttaccgtaccgtaaacgaactaactaaccgtaaccgaaaccgtaacccgttagttaccccgtacccggtacggtcggttaccacggtacccgttccggtacggttaccggaccccggtccgaacggtaaccgtaccggtacccggttacgttacgtttacccttacggtttaccggtcggttaccggaccccgtaaccgttcttaccgtaaatacccggttctaaggttttacccgggtaacgtttttgggggttcggttaaccccggggg

SEQ ID NO: 177336 - DNA, 861 bp, Homo sapiens
  misc_feature: GYAE6OF01DJ8QP.48.9.A09.1.454.CMB.1.raw
  modified_base (167)..(167): a, c, t, g, unknown or other
  misc_feature (167)..(167): n is a, c, g, or t
tcagagtatacatacacgaccggtgctcgatttagcgagacgcgcaggggcagggtgtacacctgtggttctcggggctgccctttggctttctgagagtcatggatcacatgtgacaaagaaaatgaagcacctgtggttcttcctcctgctggtggcgctccagngtgggtcctgtccgaggtgcagctgcgagggacgtcgggccaggactggtgaacgtccgttacggacgaccctcgtccctcgacgtcgctacgtgtccttcgtggtcgacctccaactacaaactaagtacgtactaactttaccgtacggtgggggcctagggacctcccggacccgtaccgggtaccccgggaagggggaacgggggtcgttaggggtaacggttgggtaacggtttaagggttaaatttacgtttacgtttaaagttaacggtaacggggtacggggtacgtaacccttaaacccgttaactttaaaccgttaacccgtttaccccgttacccgtaacggaaacggtaaccggttacggtaaccgttacccgaaacccttaacggttaaccgttaaccccggtaacgtaaaccaaaccgtaactaaaccccgaaaacggttaaacccgttaccgtttacccgtcccggttaagggaccggtaccgtacgggtacccgtcccgttgggtaacccgacccgggtacccgaccgaacggtacccgaccggttccgttaacgtttaaccgtaacgtttaccggacggttacccggtacccgtaaccccttaggttaaccgtaacctttaacgtacttaacggttaccggttacgggttttggggtttaacgggtaaacccggggg

SEQ ID NO: 177337 - DNA, 733 bp, Homo sapiens
  misc_feature: GYAE6OF01DSXGD.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtgttcttcctcctgctggtggcggctcccagatgggtcctgtcccaggtgcagctgcagggacgtccgggcccaggactgggtagaacgtcccgttacgggacgtaccccgttggtccccctcgacgttggcctacttgtcctcgtggtcgacctccactaccaaactaatacgtactacttaaccgtacggtacggggtctaggacctcccgaccgtacggtaccccggaaggggacgggtcgtggaggtaggtagttacgggtaattacgtacgttaagtttaacgtagggacgggtacgtacctaaccgttaacttaacgtaccgtccccgtaccctacgaaacgtacgtacgtaacgtacctaacctagttaaccgtacccggtaagaaccaacgtaactacccgtaaacgtaacctaccgtttaccctacccgtaggttaccggtactacggtaccgtaccccggttacgtacccggaccccgtccggacgacgtacccggacggtccttacgttacttaccgttagtcggtaccgacccgacctagtaccgattaactctaggtacgttacggttgggtttacggtaacgggg

SEQ ID NO: 177338 - DNA, 711 bp, Homo sapiens
  misc_feature: GYAE6OF01CU8J3.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtgttcttcctcctgctggtggcggctcccagatcgggtcctgtcccaggtgcagctgcgaggacgtccgggcccaggacttgggtagaacgtcccgttcggacgtaccctcggtacccctcgacggtcgctacgtgtctcgtggtcgacctcatacaaactatacgtactattacctcgtacggggctaggtactccgccaaccggtccccggaaggggtacgggtccgtagggtagtgggtacttaggtaattacgtacgttaagttacgtacgggaccgggtacgacctaaccgttacgttaacgtaccgtttaccccgtacccctagtaaacggtaacgttccggaattaccctaaccgtattaacgtacccgtaactaacgaacctaacctaacccgaaacgtaacccgttacgttacccgtaccgtaggacggtctaccggtacgtcccgtaggtcccggacccgtccgaacggacgtaccgtacggcttacgtacgttaccgtagtcggtcccacccgtaacctcgtacaacgtacttacgaagttcggtacgttcgggttacgggtacgg

SEQ ID NO: 177339 - DNA, 678 bp, Homo sapiens
  misc_feature: GYAE6OF01AOSTF.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaatgaagcacctgtggttcttcctcctgctggtggcgctcccagatgggtcctgtcccaggtgcagctgcgagggacgtccggggacccagggacgtgggtagaacggtcccgttacgggacgtaccccttcggtcccctcgaccggtgacctacttgtcctcgtggtcgacctccataccaactaatagtctaattactacggtggggctggactcccgaccacggtacccgaggggacgggctgggagtggtagttggtaattacgtacttaagttagtacggcgggatacctaaccttataacttacgtcccgttaccgtacgaaggtacgtacgacgtaccaacctagtacgtaccggaactacactaaccgtaacccaaacgtaacctacggttaccctaccgtaggtacgtcgtacggacgtccccttagggtccggacccgtccgacgacggtaccgccggtcttagtccttacgtacgtggtacccgcccgtaccctaggccttaacttactacttaggttacgttacggttgggtttacggtaaccggg

SEQ ID NO: 177340 - DNA, 613 bp, Homo sapiens
  misc_feature: GYAE6OF01BLN4D.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcgagggacgtccgggcccaggactgggtagaacgtccgttcggacgacccctgtcccctcgacgtgccactcgtcctcgtggtcgacctccataccaacaatagtactattactacggtggggctggactcccgccgacgtcccgaggggaacgggcgtggaggtggtagttggtaattactactattagaggcggagacctaactactataacgtcccgtacctagaacgtagtcgtaacgtccaacctatacgtccgtagaccactactacccgaaagaccctagttcctcccgtggacgtcgtacgacgtcccgtggtccgaccccgacgacgacgaccgcgccttgtacctttacttacgtgtcgaccctaccctagtcgtatacgtactaagtaggtacttggggttggtaaccggg

SEQ ID NO: 177341 - DNA, 582 bp, Homo sapiens
  misc_feature: GYAE6OF01EVZXF.48.9.A09.1.454.CMB.1.raw
  modified_base (365)..(365): a, c, t, g, unknown or other
  misc_feature (365)..(365): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcgctcccagatgggtcctgtcccaggtgcagctgcgaggagtccgggcccaggactgggtgaacgtccgttcggacacccctgtcccctgacgtgcacttgtctctggtgactccatcaacaatagtcattactacgtgggctggatccgccacgtccccgagggagggctgggagtggagttggtaattatactattagtagcggganctactactataactccgtcctacaagacgtcgagtccaccatataccgtaagacaacactaccaacgaacctacgtttcctacccgtagacgtctcggacgtcccgtggtaccgacccgccggacacggacccacgggtctacggttaccttacgttacgtcggttcgacccgaaccctctacgatacgtacattgacgttgggttggttaacgggg

SEQ ID NO: 177342 - DNA, 803 bp, Homo sapiens
  misc_feature: GYAE6OF01DGVR0.48.9.A09.1.454.CMB.1.raw
  modified_base (162)..(162): a, c, t, g, unknown or other
  misc_feature (162)..(162): n is a, c, g, or t
tcagagtatacatacacgaccggtgctcgatttagcgagacgcgcaggggcagggtgtacacctgtggttctcgggctgccctttggctttctgagagtcatggatcacatgtgacaagaaatgaagcacctgtgttcttcctctgctggtggcgctccagngtgggtcctgtcccaggtgcagcgtgcgagggacggtccgggcccaaggtcgtgggtagaacgtcccgttacgggacgtaccccttcggtcccctacgacgtcgcctacttgtccttcgtggtcgtacctccaataccaaacgtaattacgtactacgtttacgtacggtcgggggacttcggaccttcccgccgtaccggtacccggaagggggacgggtcgtagggacggtaggtaagtttaggtaaactttacgttacgttaagtttaacggacgggtacggggactaaccctaaccgttaacttaacgtaccttccccggttaccctagtaaacggtccgttaccggacgtaacccctacctacgttaaccgtacccgtaaacgtaccaaccgtaaccgttaacccgaaccgttaaccctttaccgttccccgtaaccggtcgggtaccgttacgtaccggacccggttcccgtaagggccccgtaacccgtcccggacgaaccgcggtaccgtccgtttaccgtatttacccgttacgttccgggaccgtaccccgtaccctaggtttaacccgaacgtttacgccgtttaaacggtccggtttggggttttacgggtttcggggtaaccccgggg

SEQ ID NO: 177343 - DNA, 549 bp, Homo sapiens
  misc_feature: GYAE6OF01DS33X.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaacgcccgttcggacgaccctgtcccctcacgtgcactgtctcgtggtgactccatacaacaatagtcattactacgtggggctggactccgccacgtccccgagggagggctggagtggattggaattatctagttagtacggcggagctacctactatactccgtccacaagagtcgatcaccatactcgtacacacactaccaacgtaacctgttcctcccgtgacggtctagcgtcccgtgtacgacccgccgcgacgaccgacgtcttcttctacttacgtcgtcgaccaccctagacgtatactcatgtacgttggttggtaacggg

SEQ ID NO: 177344 - DNA, 646 bp, Homo sapiens
  misc_feature: GYAE6OF01AETYB.48.9.A09.1.454.CMB.1.raw
  modified_base (608)..(608): a, c, t, g, unknown or other
  misc_feature (608)..(608): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccgagatgggtcctgtcccaggtgcagctgcaggacgtccgggcccaggactggtgaacgtccttcggacgacccctgtcccctcgacggtcgcctacgttgtccgtcgtggtcgacctccatacaactaattagtactattacctacggtggggctggacctccgccgacggtcccgaaggggacgggcgtagggagtcggtattaggaactttgtacttagttacgacggcgggactacctaaccttaagtaacgtacttccccgtaccgtacgaaggtcgttaccgacttaccgaacctacgttacgtacccgtaacgaactacgtaactacccgaaagacccgttacgttccctaccgtggacgtcgtacggacctccgtaggcccgtaccgccgacgtacgaccgacgtctagtacttacgtcgtcgtaccgcctaccgtnacgtatacgtacgtagtcgttaggttggttggtaccgg

SEQ ID NO: 177345 - DNA, 695 bp, Homo sapiens
  misc_feature: GYAE6OF01EGGBK.48.9.A09.1.454.CMB.1.raw
  modified_base (652)..(652): a, c, t, g, unknown or other
  misc_feature (652)..(652): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (664)..(666): a, c, t, g, unknown or other
  misc_feature (664)..(666): n is a, c, g, or t
  modified_base (668)..(679): a, c, t, g, unknown or other
  misc_feature (668)..(679): n is a, c, g, or t
  modified_base (681)..(681): a, c, t, g, unknown or other
  misc_feature (681)..(681): n is a, c, g, or t
  modified_base (683)..(692): a, c, t, g, unknown or other
  misc_feature (683)..(692): n is a, c, g, or t
  modified_base (694)..(694): a, c, t, g, unknown or other
  misc_feature (694)..(694): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggagatcctcttcttggtggcagcagccgcaggacgcccactcgccaggtcgcgacggtggggcagtcgtggggctgaagtgaagacggcgtgggcctcgagtgaaggtcctcctgacgaacggccttcgttggttacgtacccttccgacccggcccgacctacccgacgtaccgttcctcggcccttaccccgaacccggaaccgggccccgtaacggttcccgggtttccccctttccccccggtcgggtcccgtccccttcggcccttacccggaagggaccggtaccgtacccggttcggggtccggggggacccaaccggacccggggtccccgggccccggttggggtccccgttcgggtaccccggtttacggggtaaacccgtaaaccggggttaaccccttttaacccgtttacccgttaagtttaccgtttaaccgttaccgttaccgggttcgggtaaccggggtcccggggtggtaccgggaacggtaaacggggtcccgacgtaaaggtcgangacncgtncgcnnngnnnnnnnnnnnntngnnnnnnnnnngng

SEQ ID NO: 177346 - DNA, 872 bp, Homo sapiens
  misc_feature: GYAE6OF01BFID9.48.9.A09.1.454.CMB.1.raw
  modified_base (785)..(785): a, c, t, g, unknown or other
  misc_feature (785)..(785): n is a, c, g, or t
  modified_base (845)..(845): a, c, t, g, unknown or other
  misc_feature (845)..(845): n is a, c, g, or t
tcagagtatacatacacgaccggtgctcgatttagcgagacgcgcaggggcagggtgtacacctgtggttctcggggctgccccttggctttctgagagtcatggatcacatgtgcaagaaaatgaagcacctgtggttcttcctcctgctggtggcggctcccagatgggtcctgtcccaggtgcagctgcgaggacgtcgggcccaggacgtgggtagaacgtccgttacgggactaccccgttcgtccccttacaccggttcgacctaccgttcggtccttccgttcggggtacgtaccctaccctacttaaccaaacgtaacgttaacggttacctaacgttttaacccgttaaccgggttcgggggggtaccgttaggggtaacccgttacccccggggtaccccgtaaaccgggtttacccccccggggaaagggggggtaaaccgggggggtacccgtttagggggtaagggtttacgggttaaggttttaaccgggggttaaaatttttaaccgttaaccggtttaaaggtttaacgggttaaagggggtacccggggtaacggtaccctaaaaccccgtttaacgtttaaacgttaacccgttacccccggttaccccgaagtaaacggtaccggtaacggtacgttacccgaacctacgttaacgttccgtaacgactacctaactacccgaaacgtaaccctagttccctacccgtgaaccggtcgtacgtacgtcccgtacgaccggtcccgacgaccgagaccggtaccgtntaccgtattacctaccgttacgtccgacccgacctgtaaccgacgtaacctcttaacggngttaacggttgggtttcgggtaacggg

SEQ ID NO: 177347 - DNA, 497 bp, Homo sapiens
  misc_feature: GYAE6OF01CIQ7W.48.9.A09.1.454.CMB.1.raw
  modified_base (247)..(247): a, c, t, g, unknown or other
  misc_feature (247)..(247): n is a, c, g, or t
  modified_base (464)..(465): a, c, t, g, unknown or other
  misc_feature (464)..(465): n is a, c, g, or t
  modified_base (467)..(497): a, c, t, g, unknown or other
  misc_feature (467)..(497): n is a, c, g, or t
tcagagtatacatacacgaccggtgctcgatttagcgagacgcgcagggggagcatcacccagcaaccacatctgtcctctagagaatccccctgagagctccgttcctcaccatggactggacctggaggatcctcttcttggtggcagcagccgcaggagcccactgccaggtgcacggtggggcagtctggggctggaagtgaagaggccgtggggcctcgagtgaaggtctcctgcaggcctntggttagacctcaccgccgactccagactctggcttccaccgaacgggcccagtccggtccttcccccgtcggccgtccctcgcctcccgaggacgccacccgtcggtcgggggcacgacggcccggcccgtgggctcgccgtcggtacaacggtacctacgttcctattgtactactcgtgacggcgggcgtcggactaacgggccgacagtacgnngnnnnnnnnnnnnnnnnnnnnnnnnnnnnnnn

SEQ ID NO: 177348 - DNA, 821 bp, Homo sapiens
  misc_feature: GYAE6OF01EWEPP.48.9.A09.1.454.CMB.1.raw
  modified_base (203)..(203): a, c, t, g, unknown or other
  misc_feature (203)..(203): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccgaccggagaaattgtgttgacgcagtctcaggctaccctgtctttgtctcgaagggaancgccacctctcctgcgaggccagtgacgactagttacgtagttaattagtttcgtccgttaggtaccgagacgtaacggaaccggtccgtacggcccgtaaggtccctacccgaggtcccttccgtacctactttccgtccgtcgtccgtacgccttaaccgttacccgtaacgggaaccggccccgtacgtacgggacccctaaccgtacccgaacggtaaccgttaccggttacgtaacggggtcggtaccgtaaggggtttccgggtacccggtacgggtaacctacgtaacccgttttccgaaacctttccttacccgtaccctaagtacccgtaacgtcgtaaacggtcggacggttaccgtaccgttaagttaacgtttacgttttacgtaacgtttaacttttacgtacgtttaaccgtacctaagttacggttaacgttaggttacccgtacccttaacgtttaaccgttaaccgtttaaccggtacggggtaaccgggtaacggtaaccgggttcgggtaaagtaacggttaaccgtaaacggtaccgttaaaggttccgggtaagtacccggtacgaacccttacggtacttccgttaacgttacccg

SEQ ID NO: 177349 - DNA, 677 bp, Homo sapiens
  misc_feature: GYAE6OF01CKRBY.48.9.A09.1.454.CMB.1.raw
  modified_base (155)..(155): a, c, t, g, unknown or other
  misc_feature (155)..(155): n is a, c, g, or t
  modified_base (187)..(187): a, c, t, g, unknown or other
  misc_feature (187)..(187): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (499)..(499): a, c, t, g, unknown or other
  misc_feature (499)..(499): n is a, c, g, or t
tcagagtatacatacacgaccggtgctcgatttagcgagacgcgcaggggcagggtgtacacctgtggttctcggggctgccctttggctttctgagagtcatggatcacatgtgacaagaaaatgaagcacctgtggttcttcctcctgctggnggcggctcccagatcgggtcctgtcccaggtncagctgcagggacgtccgggcccaggtactgggtacgaacgtccgttcgggactaccctcgtcccctnacggtnctactgtcctcgtggtcactacataccaaagtatcgtatacttacgtacgtcgggggacttcggacttcccgacccgtacgggtacccggaaggggacgggtcgtgggtacgtggtaagtttaggtaactttaactcgtttaaagttaacggacggtacggggacttaccaaccgttactaacgtaaccgtccgtaacctacgaaagtcgtcgtaagtccaactagtactccggtaanaccataacacccgtaactaacctcgttacccgtcgtacggtagcccttagcctacccggttagccggaaccccgtcggaacacggtaccgacgggtctacggtttccaagttaccggtcgtacgaccccgtaaacctgtagaacttacgctaggttaccgtagttcggtggtaaccgg

SEQ ID NO: 177350 - DNA, 839 bp, Homo sapiens
  misc_feature: GYAE6OF01B8U1C.48.9.A09.1.454.CMB.1.raw
  modified_base (239)..(239): a, c, t, g, unknown or other
  misc_feature (239)..(239): n is a, c, g, or t
  modified_base (442)..(442): a, c, t, g, unknown or other
  misc_feature (442)..(442): n is a, c, g, or t
tcagagtatacatacacgaccggtgctcgatttagcgagacgcgcaggggcagggtgtacacctgtggttctcggggctgtccctttggctttctgagagtcagtggatcacatgtgacaagaaaatgaagcaccttggttggttccttccctcctggcgtgggtcggccggcctacccgagtagttcgggtccctcgtcccgaggtgcagctgcgaggcggtccggccaggtactggngaacgtccgttaggacctccctcgtccctgacgtgctacgtcgtactcgtggtaccgacctccaactacaactagttacgtacttaacgttaccgtcgggtacgggtcgtacggacctacccgaccgtaccggtaacccgggagggaccgggtgtagggtagtacgggtatagtaacttacgttattaggtagcggcgtaacnctaacctagtacctaccgtcccgtacgacgtaggtacgtacgtacgtacctacgtacgttacgtaccgtaacgacctaaaccttaccgtaaacccgaaccgttaacccttacccggttccccgttacccggtacgggtaacccgttacgggacccgttacccggtaccccggtttaaccgggcccccggttacccgggaacccgggtaacccggtaaccgggtaacccccggttacgggttccccggtttacctttaacccggtttaaccggtttaccggttaccgggtaccccggtaacccgttaaaccccgtagtttaccgggtaaacttaccggttaacggtttacggtacccgggttttaacgggtttccggggtttaggttaaccccggggg

SEQ ID NO: 177351 - DNA, 968 bp, Homo sapiens
  misc_feature: GYAE6OF01CZLX7.48.9.A09.1.454.CMB.1.raw
  modified_base (167)..(167): a, c, t, g, unknown or other
  misc_feature (167)..(167): n is a, c, g, or t
tcagagtatacatacacgaccggtgctcgatttagcgagacgcgcaggggcagggtgtacacctgtggttctcggggctgccctttggctttctgagagtcatggatcacatgtgcaaagaaaatgaagcacctgtgttcttcctcctgctggtggcggctcccagntgggtcctgtcccaggtgcagctgcgagggacggtccgggcccaggacgtgggtagaacgtccgttacggaccgtacccctcgtcccctacgacgtcgcctacgttggttccttcgtcgggttacgtaccctacctaactaccaaaacttaacgttacgttaacctaacgtttaaccggtacggttcgggggtccttacgggaccgtccccggacccgtaaccggtaccccgggaagggggtaacggggccgtaggggtaggttagggtaacgtttaagggtaactttacgttacgtttaagtttaacggtacggggtaccggggtaactaacccgttaaacccgttaacgttaacttaacccggtttccccgtaccccgttaagtaacgggtaaccggtaccggtaacgtaccctaacccgttaagttaaccccggttacccgggttaaacgaacccgtaaacccttaaacccgttaacccgtaaaacccgggttaaacccgttacccggttttacccgtacccccggtagggttaacccggtcccgttaaccgggtaccccggtttcccccggttaacgggtaccccggtacccccgggacccggtaaccgggtaaacccggtacccggtacccgggttaccgttttaccggttaacccgttttaaccggtttaaccgttaccgggtacccgggtacccctaaacccggttacgtttaaccgttaacgtttaacccgttaccggtaacggttttaccgggttaacggttttccggggggttttaaccgggtaaccgggg

SEQ ID NO: 177352 - DNA, 707 bp, Homo sapiens
  misc_feature: GYAE6OF01CWXL4.48.9.A09.1.454.CMB.1.raw
  modified_base (131)..(131): a, c, t, g, unknown or other
  misc_feature (131)..(131): n is a, c, g, or t
  modified_base (156)..(156): a, c, t, g, unknown or other
  misc_feature (156)..(156): n is a, c, g, or t
  modified_base (624)..(624): a, c, t, g, unknown or other
  misc_feature (624)..(624): n is a, c, g, or t
  modified_base (636)..(636): a, c, t, g, unknown or other
  misc_feature (636)..(636): n is a, c, g, or t
  modified_base (658)..(658): a, c, t, g, unknown or other
  misc_feature (658)..(658): n is a, c, g, or t
tcagagtatacatacacgaccggtgctcgatttagcgagacgcgcagggggcagggtgtacacctgtggttctcggggctgccctttggctttctgagagtcatggatcacatgtgacaaagaaaatgaancactgtggttcttcctctgcgtggnggcgctccagacgtggtcctgtcccaggtgcagcgtcggacgagggacggtccggggacccgaaggggtaccttggggtacggaacggttcccgttacgggaaccgtaccccttccgggtccccttacgaccggtcggtacctaaccgttcggttccttcggtacgggtacaccctacctaaagtacctaaaacgtattacgtaccttaattaccggtacgggtcgggctaggacctccgcccacgtacccgggaggggtacgggctgggtaacggtcggtattaggaactttcacgttaatagtacggccgggtaactacaccttaactaactacctcccggtacctaagaagtacgtccgtacgtacctacgaacttactaccgtaacgtaacctaacgacctaaccgaaactacgtacctccgtacccgagcgctagccgtaccgtcgaccgaccgccgagaacnccgacggtcttntacctacgttctacgccgtacncctatcctaagttcacgttacgttacggtcggttggtaccggttacggg

SEQ ID NO: 177353 - DNA, 793 bp, Homo sapiens
  misc_feature: GYAE6OF01E4CCC.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcgagggacggtccgggcccaggactgggtgaagtccgttcggacgacccctgtcccctcgacgtgcactgtctctggtcgactccataccaaactaatacgtcctattacctacggtcggggctcggacgtcccgaccgaccggtaccccggaaggggggaacggggtcgttggggaggttcggtagtttgggtaaatttactacgttaagttaggtacggaccggggtataccgtaacccgttacgttaactaaccgttaccccgttaccccgttaacgaaacggtacgttaccgggtaacgtaccgtaaccctaattaaccgttacccggtaagtaacccaactaacgtaaccccgaaacggtaaacccgtacgttttcccgtaccccggtaggtacggaccgttcgggacgtccccgttagggtacccggaccccggtaccggaccaacggaaccccgtaccgggtcccttaggttcccgttttaaacgttaacccggtcggtaccggtaaccccgtaacccgtaacgttacccggtaaatttccgtaacctaggttaccggtaccggtttttcggggtttacgggttaaccccggggg

SEQ ID NO: 177354 - DNA, 731 bp, Homo sapiens
  misc_feature: GYAE6OF01CLVCX.48.9.A09.1.454.CMB.1.raw
  modified_base (168)..(168): a, c, t, g, unknown or other
  misc_feature (168)..(168): n is a, c, g, or t
  modified_base (667)..(667): a, c, t, g, unknown or other
  misc_feature (667)..(667): n is a, c, g, or t
  modified_base (684)..(684): a, c, t, g, unknown or other
  misc_feature (684)..(684): n is a, c, g, or t
tcagagtatacatacacgaccggtgctcgatttagcgagacgcgcaggggcagggtgtacacctgtggttctcggggctgccctttggctttctgagagtcatggatcacatgtgacaagaaaatgaagcacctgtgttcttcctcctgctggtggcggcctcccagntcgggtcctgtcccaggtgcagctgcgaggcgtcgggccaggtactggtacgaacgtccgttacggacgtacccttcgtcccctacgacggtgcctacgttgtcctcgtggtcactcatacaaactatacgtctagttacgtacggtggggtctacggtacctcccgaccgtaccggtacccggaaggggtaacgggtctaggggtacgtaggtagtttaaggtaatttacgtacgttaagtttacggtacgggaccgggtaactaccctaaaccgttaagttaaacgttaccgtaccccgttacccgtaagaacggtacggtacgtaacgtaccaacctagtaaccgtaccgtaacgaacctaacgtacctaaccgaaacgtacccttagttaccccgtaccgtaggacggtcgtacgacccggttcccgttacggcccgaacccgggcccgaagtaacccggacccgtaggttccttgtttaacccctagttaccgnggtaccgaccctacccngtacgtattacacgttagtacgggtacgttcgggtttacggaccggg

SEQ ID NO: 177355 - DNA, 886 bp, Homo sapiens
  misc_feature: GYAE6OF01BISJ9.48.9.A09.1.454.CMB.1.raw
  modified_base (128)..(128): a, c, t, g, unknown or other
  misc_feature (128)..(128): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaancacctgtggttcttcctctgctggtggcggctccagatgggtcctgtcccaggtgcagctgcaggagtcggcccaggactggtgagccttacggacaccctgtccctnacggtnctactgtctcgtggtgactccatacaacaatgtactattactcgngggctgctccgccnccgaccccgagggacgggctagggtacggtaggtaggtacgggtaacttactttaacccgaacgtaagggttcggggaacgtacccgtaaaccccttaaaccgtaaccccgtaaaccccccgggttacccccttaaacggtaaaaacccggttaccggaaaccggtaacccgtaaaccctaaacgtttaacccgttaaccccgggttaaccgggaaccccgtaaccccgttaaaccccgtaaaacggtaaaacccccgttaaaaccggtttttacccccttaacccccggttaaacggaaaccgggttcccgttaaccggtaaccggttacccgttacccggttacgggtaccccgggaacccccgtacccgggaaccccgtaagggtaacccccgttaaccgggggtaccttttaaccggtaacctttaaacgtttaccggttaccgggttacccgggtaacccgggtacccgggccccccggttaacgggacccgggtaacccgggttaccgggttttcggtttaccttttttaccgggacggttttaccgtttccggttttacggttaacgtttaccggggg

SEQ ID NO: 177356 - DNA, 862 bp, Homo sapiens
  misc_feature: GYAE6OF01B6DLT.48.9.A09.1.454.CMB.1.raw
tcagagtatacatacacgaccggtgctcgatttagcgagacgcgcagggggcagggtgtacacctgtggttctcggggctgccctttggctttctgagagtcatggatcacatgtgcaagaaatgaagcacctgtggttcttcctctgctggtggcgctcccagatgggtcctgtcccaggtgcagctgcgagggacgtccggggacccaggtacgtgggtacgtaacggtcccttacgggacgtacccctcggtcccctacgaccggtgacctacgttcgtacctcgttgggtacgtaacccttaccgtaataccaaaacctaagttacgttacctaacgtttaccgtaccggttgggggtccttagggtaacccgttccccggtacccgtaacccgggttacccccgggaaggggggtaacggggtccgttaggggtacggttgggtaagtttacgggtaaatttacgtacgtttaaagttacgtacgggacgggactacccttaaccgttaacttacgttaaccttacccgttaccctacgaaaggtacggttcgtaacgtacccaaccgtaacgttaccgtaccgtaaacgacctaactacgttaacccaaacgtacccgtttacgttaccctacccgtacggtaacggtcctaacggtccgtcccgttagggtcccggaccccgtaccggacgtaacccgggacccgtacgggtacccgttagttacctttaacggttacccgttcggggtacccggtaacccccgttaacccgtacgggttacccgtaaacgtttacccgtaccgtttacggtacgggtttcggtttaaccggggttttggggtaacccccggggg

SEQ ID NO: 177357 - DNA, 656 bp, Homo sapiens
  misc_feature: GYAE6OF01ATW1X.48.9.A09.1.454.CMB.1.raw
  modified_base (421)..(421): a, c, t, g, unknown or other
  misc_feature (421)..(421): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
tcagagtatacatacacgaccggtgctcgatttagcgagacgcgcagggacggaccggtgctcgatttagcctctacgctcagggcaccgaccggtgctcgatttagacttcgtctgtgttggggtttggggggtgtcggtcggtactccactcccgcgttagaacgaggctgtattactactgtctagtctttcgaacttaacaactaattcacggttcgggtacgttacgggcgggacggtacccacgtccgtcgacccggtccgtacggtaccgacgacccgaaggtccgtccgacccccttcggtacctaccgttccgttaccgttaccccctacccttccgtacttacgtacgtaccttaccgtcgtacggacggtccggtccgtacggaccgtaacggtccgtacgtacgtagcncgcgcgctacgtacgtacncgcgtacgtacgtcgtacgtacgtcgtgtgagngactctctacgtactcacacacgcgacactactcgctacgtcgtactacgtatactacgtacttattactctctctactatagttagtagtacgtgtcgtcgtacgtacgtacgacgtacgtacgtacgtagtacgtagtacgtagtagtggacggtatacgtactactactacgtctcctcg

SEQ ID NO: 177358 - DNA, 693 bp, Homo sapiens
  misc_feature: GYAE6OF01B271Z.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccagggtgcagctgcgagggaggtcgggcccaggacgtggtagaacgtccgttcggacgtccctcgtccctcacggtcgcacgttgtcgtcgtggtcgactccactacaactaatacgtactacttacgtacgtgggggtctcgggactcccgccgaccggtaccccggagggggaacgggccgtgggaggtggtagttacggtaatttagtacttaagttaagtaggtacgggaataccgtaaccttaactaactaacgtccccgttacctacgaaaggtacgtacggtaacgtccaaccgtactacgtacgtaacgactaacctactaacccaaacgtaacccttacgttacccttacccggtagtacggtcgtacggccgtcccgtcggtaccggacccggtccgaacgacggacccgtacggtccttcgttacgttacgttcgtacggtaccgaccgtaacctaggtaccgtatactacgtagttagtacggttcgggttaaggtaccggg

SEQ ID NO: 177359 - DNA, 816 bp, Homo sapiens
  misc_feature: GYAE6OF01CU4LF.48.9.A09.1.454.CMB.1.raw
  modified_base (171)..(171): a, c, t, g, unknown or other
  misc_feature (171)..(171): n is a, c, g, or t
tcagagtatacatacacgaccggtgctcgatttagcgagacgcgcaggggcagggtgtacacctgtggttctcggggctgccctttggcttttctgagagtcatggatcacatgtgacaaagaaaaatgaagcacctgtggttcttcctctgctggtggccggctcccagngtggtcctgtccagctgcagctgcagggacgtccgggccaggtacgtggtagaacgtccgttccggacgacccttcgtcccctcaccgtcgctacgttcgtcctcgttcgggtcgtcccttaccgacttacgacggaccagtaccgtaacgtttaaccgtttccgtttcggtcggggtccttacgggaccccttccccggacccgacccgggtacccccgggaagggggtaaccggggtcgtaggggtacggttagggtacggtttacgggtaactttaaccgtttaacccgaaggtaggggtacgggacctaacccgtaacccgtaaccgtaaccccgtaaccccgtaccgtaaacgtaaaacggtccggacggaccctaaccgtagttaccgtaccgtaacgaaccgtaccgtaaacaaaccgtaaccttacttccccgacgtagaacgtccgtaacgtcgtccgttcgtaccggtaccgccccggtaaccgtcgaaacggtacccgtaccgggttcttaaccgtttaccgttacgttaccggtcgggtacccggaaccccgggtacccgaccccgggaaggtccccgtagggttacgtttccgggtttaactttacgggacgttccgttttccggttaaagg

SEQ ID NO: 177360 - DNA, 730 bp, Homo sapiens
  misc_feature: GYAE6OF01AQYEP.48.9.A09.1.454.CMB.1.raw
  modified_base (201)..(201): a, c, t, g, unknown or other
  misc_feature (201)..(201): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtggttcttcctcctgcgtggtcggcggctcccagatgggtcctgtcccaggtcgcagctgcgaggngtccgggccaggactggtgaacgcccgtttacggacgaccccttcgtcccctcgacgtgacctacgttcggtccttcgtcgggttacgtacctcctactacaaccgaattacggtactacttacgtaccggtggggtcgtcggaccgtcccgacccgtacggtacccccggtaagggggaaccgggtccgtaaggggaggttaggtagttacggaatttaactacgttagttaagtacggggcggtaacgcccgtaacctacgttaataacctcccggtacccctacgaaacgtcggtacgtaccgtccaaccgtattaccgtaccgttaacgaaccgtacaccgtaaccgaacgtaacctacggttccctaccgtcgtacggctacggcgtcccgttacggtccgacccgtccgacgacgtaaccggcgtaccgttgtccgtacgtttcacgggtaccctcccggtaccctacggttaacgcttacgttacgaacgtttggtaacgttcgggtttacgggttaccggg

SEQ ID NO: 177361 - DNA, 793 bp, Homo sapiens
  misc_feature: GYAE6OF01ANBKB.48.9.A09.1.454.CMB.1.raw
tcagagtatacatacacgaccggtgctcgatttagcgagacgcgcagggggcagggtgtacacctgtggttctcggggctgccctttggctttctgagagtcagtggatcacatgtgacaagaaaatgaagcacctgtcggttcttcctcctgcgtggtggcggctcccgagagtcgggtcctgtcccaggtgcagctggcgagggcgtccgggccagggtctggtacgacgcccgttcggaccgtacccgtcgtccctacgacggtcgcgtaccgttcgttccgtcgttcggtcgacctacctaactaccgtaaactaacgtacgttacctaacgtttaaccgtaccggggtcggggtactaccgggccttccccggaccgtaccgggtacccgggagggggaacgggtcgtacgggtaggtacggttagttaaggtaatttaccgttagttaagtacggtacgggacgggacctacctaaaccttacgttaactacccgtcccttaaccgtacgtaacgggtacgtacggtaactaccacgttagtaccggtacctaacgactaaccgtaactaaccgaactaacccgttacttccccgtacggtacgaccggtacgtaccggtacctccggtaccggtacccggacccgtccgaaacgtcccggaaccgtaccggttacgttaccgttacgttaccgttacgtccgtaccccgggtaacctacccggacttaccgtacgttaacgtcccgtaaggttaccgggttaggtttacgggtgggttaaccccgg

SEQ ID NO: 177362 - DNA, 927 bp, Homo sapiens
  misc_feature: GYAE6OF01CFHD8.48.9.A09.1.454.CMB.1.raw
  modified_base (217)..(217): a, c, t, g, unknown or other
  misc_feature (217)..(217): n is a, c, g, or t
  modified_base (821)..(821): a, c, t, g, unknown or other
  misc_feature (821)..(821): n is a, c, g, or t
tcagagtatacatacacgaccggtgctcgatttagcgagacgcgcagggcagggtgtacacctgtggttctcgggctgccctttggctttctgagagtcatggatcacatgtgacaaagaaaatgaagccaccgtggttcggtttccttccctccgtgcgttgggtcggccggcctaccccgaggtacgtcgggttcccttgtaccccgagggttcnccgacggccgttacgaccgtagggtacggtcccgggaccccgtaagggtacctggggtacgaaaccgttcccggttacgggaaccgtacccccgttccggttccccctacggacccggtctaccgtaaccgttcgttcccgttcggttcgggtaaccgtacccgttaccctaacttaaccaaacgtaacgtttacgttaccttaacgtttaccggtacggttcggggtacctttacggacccgtaccccggtaccctaaccgggacccccgggttaagggggaaccgggttcggttacggggtaacggttacggttaacgtttaaggtaacgttttacgttaaccgttaagtttaacgggtacggggtaacggtaccgttacccgtaaacccgtttaacgtttaaccgttacccttaccccggttaccgtaaacggtaccggtacggtacccgttaaccgttaccccgaaacgttaacgtttaacccggttacccgaaacgtaacccaaccgtaacgttaacccgaaccgttaaacccgttccggttacccgtccgtaacgggtcgtaccgtaccgtccgtaccgtccggaccgtcccggaacnccgtaacgtaccgtcggttctaccgttacgttccgtacgtcggtcctaacccggacccttagacccttagttacgactacgttacgttcgttgggtaccggtacgg

SEQ ID NO: 177363 - DNA, 830 bp, Homo sapiens
  misc_feature: GYAE6OF01CDEO1.48.9.A09.1.454.CMB.1.raw
  modified_base (157)..(157): a, c, t, g, unknown or other
  misc_feature (157)..(157): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (702)..(702): a, c, t, g, unknown or other
  misc_feature (702)..(702): n is a, c, g, or t
tcagagtatacatacacgaccggtgctcgatttagcgagacgcgcgaggggcagggtgtacacctgtggttctcggggctgccctttggctttctgagagtcatggatcacattgtgacaaagtaaaaatgaagcaccgtgttggttcttcctccgngctgggtcgcggctcccagtgtcgggtcctgtcccgaggtgcngctgngtacggacgtcccgggaccnggtacgtggtacgaaccgtcccgttacggaccgaccccttcgtaccctgacggtcgccgttacttcggttcctcgttcggtacgtacccttaccacgtaactaaaagtagtacgttaccttaacttacgacggttcggggtcgtacggcctacccggaccgtaccggtaacccgggaaggggtaacggggttcgtaggggttacggtacgggttaaggttacggtttaaacgtttacgtttaacgttaacggtttaacgttacggggaacggggttactaacccgttaaccgttaacgttaacctttaaccgttacccccgtaccgtaaacgtaacgttaccggttaacggtaccgttacccaaccggttaacgttaaccgttaacccggaaacgacctaaccgttaaaccgtaaaccgtaacccgttaacccttaacgttcccgtttaaccgacgggtaaccgtacgtaccgaccnccgggtttcgaaccgccggtcgaaccgtaggacccctgggtaccttacggtacttagttaccgacgtccgacgtacctacgtacgtacttcgtaactacgttacggacgtttggttcgggtaacccgg

SEQ ID NO: 177364 - DNA, 859 bp, Homo sapiens
  misc_feature: GYAE6OF01C8D27.48.9.A09.1.454.CMB.1.raw
  modified_base (163)..(163): a, c, t, g, unknown or other
  misc_feature (163)..(163): n is a, c, g, or t
  modified_base (261)..(261): a, c, t, g, unknown or other
  misc_feature (261)..(261): n is a, c, g, or t
tcagagtatacatacacgaccggtgctcgatttagcgagacgcgcaggggcagggtgtacacctgtggttctcggggctgccctttggctttctgagagtcatggatcacatgtgacaagaaatgaagcacctgtgttccttcctctgctggtgcgctccagntggtcctgtcccaggtcgcagctggacagggacgtccgggcccagggtactgggtagaacgtcccgttcggaccgtacccttgtccccttcgacgtcncctacgtgttcttcgtcggtcgtacctaccaacttaccaaactaacgttaacgtactaacgtttaacgtacggtcgggggtacgttcgggtacccgtcccggaacccgtacccggggtaacccccggggaaggggggtaacggggtaccggttaggggtaacggttacggggttaaaggtttaacgggtaaacttttacgttaaccgtttaaggtttaacggtaacggggaccggggtaaccgtaacccgttaaaccgtttaaacgttaaccttaaccgggtttacccccgtacccgttaacggtaaaccggtaacgggtttccgaacggttaccccaaccgttaacgttacgttaacccgtacgaacctaacctaactaacccgtaacgtaacccgttacggttacccctcccggtaaaggtccggtacgtaccggaccgtccccgttacgggacccggtaccccggccgtacgaacggacccgtacggtaccgttacggttacttaacgttcggttacgtaccgtaaccccgtaccgtacttaccgtaataccgttacgttaacgttcgttacggttgggtttaccgggtaccggg

SEQ ID NO: 177365 - DNA, 686 bp, Homo sapiens
  misc_feature: GYAE6OF01EGCSH.48.9.A09.1.454.CMB.1.raw
  modified_base (362)..(362): a, c, t, g, unknown or other
  misc_feature (362)..(362): n is a, c, g, or t
  modified_base (530)..(530): a, c, t, g, unknown or other
  misc_feature (530)..(530): n is a, c, g, or t
  modified_base (571)..(571): a, c, t, g, unknown or other
  misc_feature (571)..(571): n is a, c, g, or t
  modified_base (584)..(584): a, c, t, g, unknown or other
  misc_feature (584)..(584): n is a, c, g, or t
tcagagtatacatacacgaccggtgctcgatttagcgagacgcgcaggggcagggtgtacacctgtggttctcggggctgccctttggctttctgagagtcagtggatcaacatgtgacaaagaaaatgaagcacctgtcggttccttcctctgctggtcggcgctccgagtgtcgggtcctgtcccgaggtgcagccgtgaccgagggacggtccgggacccgagggtaccgtagggtacgaaaccgtccgttacggaccgtcccctcgtcccctcgaccggtgaccagttcgttaccgttcgtacggtaccgacctaccgaactaacctaaacgtaagttcgtactacgttacgtacggngggtctacggtacctcccgacgaccggtaccggagggaggtacgtggtagtaggtacttagtaatttacgtacgtaagtaggtacggacggtacacccgtaacttaactaacgtaccgtcccgtaactcgaaagtcgtaccgaatcccaactattaccgtaccgtaanacctacgaccttaaccgaaacgttacccttgtacccgtacngacgtcacgtacncccgtagtaccgccgacgtacgaccggacgtacctcttaacgtcgttagtccggtgccgaccgacgtcccgagtgacgttgtcgttactgtagtcgttaacg

SEQ ID NO: 177366 - DNA, 645 bp, Homo sapiens
  misc_feature: GYAE6OF01BACOX.48.9.A09.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctccagatgggtcctgtcccaggtgcagctgcaggagtcgggcccaggactggtgaagccttcggacnccctgtccctnacgtgcactgtctctggtgactccatcaacatagtacattactactggggctggatccgccacgtccccgaggggaagggctggagtggacttagggaattactctagttagtaggcgggaagactaccttactaagttaaactccccgtaccttacgaaacggtacgtaccgaggttaccacctaacttacttaccggttaacgaactaccacttacccaaacggtaacccttaagttcccttccccgtaggaaccggtcgtacggacgtcccgttaggccgacccgggtcccggtaccaacggtaccgacccggtacttcggtacctttagttaccggttcgtacggtcccgaccctagtaccctatacgtcgaacttgaccgtttgggttacggtttaccgggg

SEQ ID NO: 177367 - DNA, 880 bp, Homo sapiens
  misc_feature: GYAE6OF01EGNQW.48.9.A09.1.454.CMB.1.raw
tcagagtatacatacacgaccggtgctcgatttagcgagacgcgcaggggcagggtgtacacctgtggttctcgggctgccctttggctttctgagagtcatggatcacatgtgcaagaaatgaagcacctgtggttcttcctctgcgtggtggcggctcccagagtgggtcctgtcccgaggtcgcagctggcgaggacgtcgggcccaggacgtggtagaacgtccgttacggacgaccccttcgtcccctacgacggttcgacctacgtcgttcctcgtggtacgacctccacgtaccaaactaagtacgtactattaccgttacggtggggtcctagggacctcccggaccgaccggttaccccggaaggggtaacgggtcgtagggtacggttcggtaaggttaggtaatttacgtacttagttaacgacgggtacggacgtacctaaccgttactaacgttaaccgtaccccgttaccgtaaccgtaaaggtacgtacccgtaacggttaaccaacccgttaagtttaccggttaacccggtaaagtaaaccctaacccgttaaaccgtaacccgtaaaacgggttaaccccttaacggtttccccccgttaaaccggtacgggtaacccgggttacccgtaaccgggttacccgtcccccggttaacgggtttacccccggaccccgggtaccccgtaaccggtaaccccggacggttacccggttaccgttaacggtttaccgtttaaaccgggttacccggttacggtcccggtaaaccccgggtaaccctaggttaaccccgtaagttaaacccggttacgtaacgggttaacgggttttccgttaacggggtttggggttaaccccggg

SEQ ID NO: 177368 - DNA, 735 bp, Homo sapiens
  misc_feature: GYAE6OF01DQNYY.48.9.A09.1.454.CMB.1.raw
  modified_base (541)..(541): a, c, t, g, unknown or other
  misc_feature (541)..(541): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaatgaagcacctgtgttcttcctcgtgctggtggcgctcccagagtcgggtcctcgtccgaggtcgcgagcgtcggcgagggacggtcccgggcccgagggtaccgtgggtacgtaacggtcccggttacggaaccggccccttccggtccccctacgaccgttcggacctaccgtcgtttccgttcgtaggtacgaccctaccactaacaaactaagtactactaacgtttaccgtaacggttgggggtacctcggtacgtccccggacccgtaccgggaccccgggagggggtacggggacggttaggggtaaggttggtaagttaggtaacttactattagtagtacggcggacgtacctacttaactactaccgtccgtacctagagtacgtcgacgtaccactagtactaccganacctactaacctacgaactaccttccgttacctcgtgacgtcgtaccgtccgtaccgtcgaccggacccgtcgacgcggtaacccgtcggtccgtttaccttagttaacccgttcggtacgccgtaacccgaccttacgtacgtacctcgtaacttcggtaaacccggtttggttcgggtttacggtaccgggg

SEQ ID NO: 177369 - DNA, 888 bp, Homo sapiens
  misc_feature: GYAE6OF01C9V2R.48.9.A09.1.454.CMB.1.raw
  modified_base (252)..(252): a, c, t, g, unknown or other
  misc_feature (252)..(252): n is a, c, g, or t
  modified_base (415)..(415): a, c, t, g, unknown or other
  misc_feature (415)..(415): n is a, c, g, or t
tcagagtatacatacacgaccggtgctcgatttagcgagacgcgcaggggcagggtgtacacctgtggttctcggggctgccctttggctttctgagagtcatggatcacatgtgcaaagaaatgaagcacctgtgttcttcctcctgctgatggcgctccagatcgggtcctgtcccaggtgcagctgacgaggacggccgggccaaggacgtggtagaacgtccgttaccggacgacccgtcgtcccctnacgtcgaccacgtcgccttcgtggtcacctaccaataacaaactaatacgtactaacgttaccgtacggtcgggactacgggacctcccgacccgtaccggtacccggaagggggtaaccgggtgttacgggacggttagggttaacttagggtaaaactttnttaacgttaacgtttaagggtacggaccgggggtaactaaccctaaacccgtttaactaaacgttaaacccgttccccggttaaaccccttaggtaaaacgggttaccgttaacccggtaacgttacccgtaaacccgttaacgttaacccggtaaccggtttaaaccggaaaccctaaaacccttacccggttaaaaccccgtaaaacgttaacccccggttaacgttttacccccgtacccgtaacggggtaccggtcgttaaccggaacccggtttccccgtagggtaaccccggtcccggaacccggacgtaaccgggtacccgccgggttaacccttttgggaacccttttaaggtacccgggttcggtacccgtaacccccggtaaaccttaagggttaaccttaacgttaaccgtaaaccgttacggtttaccggggttacggtttttagggggttaaacccgggg

SEQ ID NO: 177370 - DNA, 995 bp, Homo sapiens
  misc_feature: GYAE6OF01CRGM7.48.9.A09.1.454.CMB.1.raw
  modified_base (217)..(217): a, c, t, g, unknown or other
  misc_feature (217)..(217): n is a, c, g, or t
tcagagtatacatacacgaccggtgctcgatttagcgagacgcgcaggggcagggtgtacacctgtggttctcggggctgccctttggctttctgagagtcatggatcacatgtgacaaagaaaatgaagccacctggtcggtttccttccctccgtggcgttgggtcgggccggaccttcccgaggacgttcggggtccctcgtacccgagggtcnccgagtccgttggacgtacggggcggtacccggggaccccaagggtaccttaggggacggaaaccggttccccggtttacccgggaaccgtacccccgttacgttcccccgttaccgtaccgggttacgacccgttaaccgtttcggtttccctttaccgggttacggggtttaccaaccccttaccctaacgtaaaccctaaaaaccggttaattaaccggttaccctttaaacgtttaccgtaccgggggtttccggggtacgtaaccgggtccgttacccccggaccccgttaacccggggacccccggggtaaagggggacggggtccgttaaggggtacggttaagggttaacgtttaaggttaaatttacggttaacttaaggtttaacggacggggaccgggtactaaccgtaaccttaacgttacgtaaacccgttcccgttaacccgtaacggaaacgttacggttccgaaaccgtacccgaaacccttaacggttaccgtaccggttaaaacaaccgttaaaccgtaaccctaacccgtaaaaccgtaaaccgttttcccgttaaccggtccccggtaaaggttcccgggtaccgtaacgggttcccgacccggttaaccggtaccccggaccgtacccgacgaaacgtcccggaggttaccttacgggtccttaaaggtccgttaccggccgaaccttacccgtacgttaacgtaaccgacgttacggtacgttaccggtttaggggttcgtttacgggaaacgggg

SEQ ID NO: 177371 - DNA, 130 bp, Homo sapiens
  misc_feature: GYAE6OF02IQ7TT.48.9.A09.1.454.CMB.1.raw
  modified_base (130)..(130): a, c, t, g, unknown or other
  misc_feature (130)..(130): n is a, c, g, or t
tcagagtatacatacacgaccggtgctcgatttagcgagacgcgcagggcacgaccggtgctcgatttagagctcacgtattgggtttgggggtttttaggtatctgagcgggctggcaaggcgcatagn

SEQ ID NO: 177372 - DNA, 416 bp, Homo sapiens
  misc_feature: GYAE6OF02HTODX.48.9.A09.1.454.CMB.1.raw
  modified_base (413)..(416): a, c, t, g, unknown or other
  misc_feature (413)..(416): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtcttcccctggccgccctgctccaggacgcacctctgggggcacagcggccctgggctgcctggtcaaggactacttcctatgtatactctgagcgggctggcaaggcgcatagnnnn

SEQ ID NO: 177373 - DNA, 415 bp, Homo sapiens
  misc_feature: GYAE6OF02FZR2W.48.9.A09.1.454.CMB.1.raw
  modified_base (412)..(415): a, c, t, g, unknown or other
  misc_feature (412)..(415): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggccccatcggtcttccccctggcgccctgctccaggagcacctctgggggcacagcggccctgggctgcctggtcaaggctacttcctctctcgactctgagcgggctggcaaggcgcatagnnnn

SEQ ID NO: 177374 - DNA, 498 bp, Homo sapiens
  misc_feature: GYAE6OF02GSBU5.48.9.A09.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccaggctcccaggctcctcatctctgctgcatcctanagggccactggcatcccagacaggttcagtggcagtgggtctgggacagacttcactctctccatcagcagactggagcctgaagatttgctaatttattactgtcaccagtatgtagctcacctctaactttcggcggtagggaccaggtggagatacaaacgaactgtggctgcaccatctgtc

SEQ ID NO: 177375 - DNA, 509 bp, Homo sapiens
  misc_feature: GYAE6OF02GHTU4.48.9.A09.1.454.CMB.1.raw
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (411)..(411): a, c, t, g, unknown or other
  misc_feature (411)..(411): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtcccagggagggctggagtggattggaattatctattatagcggancactactataatccgtcctanaagagtcgagtcaccatactccgtagacacatccaagaaccngttcctccctgacgctgacgccctgcgaccgccgacacgacacggctgtctagttactgtcgccaccatcgattactcagtgacgttggtgttacggg

SEQ ID NO: 177376 - DNA, 507 bp, Homo sapiens
  misc_feature: GYAE6OF02GDU0V.48.9.A09.1.454.CMB.1.raw
  modified_base (377)..(377): a, c, t, g, unknown or other
  misc_feature (377)..(377): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaagggctggagtggattggaattatctattatagcgggagcacctactataatccgtccctcaagngtcgagtcacatatccgtagacacatccaaagaaccagttcctccctgacggctgagccctgtcgaccgccgcagaccacggctgtctatactgtcgcgacccatcgatactcatgacttggtgtacggg

SEQ ID NO: 177377 - DNA, 281 bp, Homo sapiens
  misc_feature: GYAE6OF02HIE83.48.9.A09.1.454.CMB.1.raw
  modified_base (281)..(281): a, c, t, g, unknown or other
  misc_feature (281)..(281): n is a, c, g, or t
tcagagtatacatacacgaccggtgctcgatttagcgagacgcgcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagn

SEQ ID NO: 177378 - DNA, 499 bp, Homo sapiens
  misc_feature: GYAE6OF02IY7NG.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggagggctggagtggattggaattatctattatagcggagcactactataatccgtccctcaagagtcgagtcaccatatccgtagacacatccaagaaccagttctccctgagctgagccctgtgaccgccgcagacacggctgtctattactgtgcgacccatcgatactcatgacttggtgtacggg

SEQ ID NO: 177379 - DNA, 423 bp, Homo sapiens
  misc_feature: GYAE6OF02HFQUZ.48.9.A09.1.454.CMB.1.raw
  modified_base (326)..(326): a, c, t, g, unknown or other
  misc_feature (326)..(326): n is a, c, g, or t
  modified_base (415)..(423): a, c, t, g, unknown or other
  misc_feature (415)..(423): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtcttcccctggccgccctgcctccaggngcacctccgagagcacagccggccctgggctgcctggtcaaggactactttcctatgtatactctgagcgggctggcaaggcgcatagnnnnnnnnn

SEQ ID NO: 177380 - DNA, 506 bp, Homo sapiens
  misc_feature: GYAE6OF02I0P93.48.9.A09.1.454.CMB.1.raw
  modified_base (455)..(455): a, c, t, g, unknown or other
  misc_feature (455)..(455): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaagccttcggagaccctgtccctcacgtgcactgtctctggtgactccatcaacaatagtcattactactggggctggatccgccagtccccgagggagggctggagtggattggaattatctattatagcggagcactactataatccgtcctcaagagtcgagtcaccatactccgtagacacatccaaagaaccagtttctccctgagctgacgccctgtcgaccgccgcacgacncggctgtctagttactgtcgcgacccatcatatcatgacttggtgttacgg

SEQ ID NO: 177381 - DNA, 419 bp, Homo sapiens
  misc_feature: GYAE6OF02HYAO9.48.9.A09.1.454.CMB.1.raw
  modified_base (406)..(406): a, c, t, g, unknown or other
  misc_feature (406)..(406): n is a, c, g, or t
  modified_base (411)..(419): a, c, t, g, unknown or other
  misc_feature (411)..(419): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtccttcccctggccgccctgctccaggagcacctctgggggcacagcggccctgggctgcctggtcaaggctactcctatgtatactctgagcgggctggcaaggcgnatagnnnnnnnnn

SEQ ID NO: 177382 - DNA, 507 bp, Homo sapiens
  misc_feature: GYAE6OF02FSEVW.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaagggctggagtggattggaattatctattatagcgggagcactactataatccgtccctcaagagtcgagtcaccatatccgtagacacatccaagaaccagttctccctgaggctgagccctgtcgaccgccgcagacacggctgtctattactgtcgccgacccatcgatactcatgacttgggttgtacggg

SEQ ID NO: 177383 - DNA, 625 bp, Homo sapiens
  misc_feature: GYAE6OF02FE66Y.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaagccttcggagaccctgtccctcacgtgcactgtctctggtgactcatcaacaatagtcattactacgtggggctggactccgccacgtcccgagggacgggctagggagtggagttggaattatctattagtaggcgggagcaaccttactaactaaacgttcccgtaccctacgaaaggagtcgtaagtcaaccatactacccgtagaacctacactacccaaagtaaccctagttccctacccgtgacgtctacgacgtccctggtccgacccgccgacgtacgaaccgtaccggtcttacggttacttacgttaccgtcggttcggacccggtaaacccctagttacccggaattaaccgtacctaagttaccggtaccggtttgggtttaggttaacccgggg

SEQ ID NO: 177384 - DNA, 416 bp, Homo sapiens
  misc_feature: GYAE6OF02FPU7H.48.9.A09.1.454.CMB.1.raw
  modified_base (413)..(416): a, c, t, g, unknown or other
  misc_feature (413)..(416): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtcttccccctggcgccctgctccaggagcacctctgggggcacagcggccctgggctgcctggtcaaggactacttcctatgtatactctgagcgggctgggcaaggcgcatagnnnn

SEQ ID NO: 177385 - DNA, 493 bp, Homo sapiens
  misc_feature: GYAE6OF02IFIZI.48.9.A09.1.454.CMB.1.raw
  modified_base (312)..(312): a, c, t, g, unknown or other
  misc_feature (312)..(312): n is a, c, g, or t
  modified_base (491)..(491): a, c, t, g, unknown or other
  misc_feature (491)..(491): n is a, c, g, or t
tcagagtatacatacacgaccggtgctcgatttagcgagacgcgcagggtgcctggagactgcgtcaacacaatttcccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacnggccatggcatcccagacaggttcagtggcaggtggtctgggacagacttcactctctccatcagcagactggagcctagaagtattttgactaatttattactgtacacctagtatgtagctcacctctacttcggcgaggacaggtgagatacaacgtactagtgcgtgcacatctntc

SEQ ID NO: 177386 - DNA, 525 bp, Homo sapiens
  misc_feature: GYAE6OF02H9YG2.48.9.A09.1.454.CMB.1.raw
  modified_base (239)..(239): a, c, t, g, unknown or other
  misc_feature (239)..(239): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctnacgtgcactgtctctggtgactccatcaacaatagtcattactacgtggggctggactccgccacgtccccgagggagggctggagtggattggaattatctattatagcggancactatataactccgtcctanaagagtcgagtccaccatatccgtagacacactaccaaagaacctagttcctccgtgaggtctagacgccctgtcgaccgccgacacgacgacggctgtccttatacgtgtcgaccgacctagtcgatatcatcgtagttcggttgtacgg

SEQ ID NO: 177387 - DNA, 283 bp, Homo sapiens
  misc_feature: GYAE6OF02ILY27.48.9.A09.1.454.CMB.1.raw
  modified_base (280)..(283): a, c, t, g, unknown or other
  misc_feature (280)..(283): n is a, c, g, or t
tcagagtatacatacacgaccggtgctcgatttagcgagacgcgcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttccccgcctcctctatgtatactctgagcgggctggcaaggcgcatagnnnn

SEQ ID NO: 177388 - DNA, 580 bp, Homo sapiens
  misc_feature: GYAE6OF02IVG7J.48.9.A09.1.454.CMB.1.raw
  modified_base (201)..(201): a, c, t, g, unknown or other
  misc_feature (201)..(201): n is a, c, g, or t
  modified_base (400)..(400): a, c, t, g, unknown or other
  misc_feature (400)..(400): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcacctgtctttgctccaggggaaanagccacccgtctccgtgcagggcccagtcgagacagttacctgttaaattatttggcctggtacccagcagaagcctggccaggctccccaggctcctcatctctgctgcatccgtacagggccactggccatcccagacaggttcaggtgcagtgggtctgggacagacttcactctactccatcagcagtactggancctgaacgtattttggactaattttattactgttactaccaggtataggtacgcttctacccgttattaaaccgtttcggaccggtaagggtacccgaagggttggaacggtaattacctaaaaccgggaaccttaggtacgggaccttcgggaccctaaccgacttccgttgttacccg

SEQ ID NO: 177389 - DNA, 498 bp, Homo sapiens
  misc_feature: GYAE6OF02GJ3TU.48.9.A09.1.454.CMB.1.raw
  modified_base (203)..(203): a, c, t, g, unknown or other
  misc_feature (203)..(203): n is a, c, g, or t
  modified_base (491)..(491): a, c, t, g, unknown or other
  misc_feature (491)..(491): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattattggcctggtaccagcagaagcctggccaggctcccaggctcctcatctctgctgcatcctacagggccactggcattccagacaggttcagtggcagtggtctgggacagacttcactctctccatcagcagactggacgcctgaagtattttgctaatttattactgtccacagtatggtagctcacttctaacttcggcggaggacaggtgagagtacaacgaactgtaggctgcacctntctgtcc

SEQ ID NO: 177390 - DNA, 666 bp, Homo sapiens
  misc_feature: GYAE6OF02FED3J.48.9.A09.1.454.CMB.1.raw
  modified_base (235)..(235): a, c, t, g, unknown or other
  misc_feature (235)..(235): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctctgctggtgcgctcccagatggtcctgtcccaggtgcagctgcaggagtcgggcccaggactggtgaagccttcggagaccctgtccctnacgtgcactgtctctggtgactcatcaacaatagtcattactacgtgggctggactccgccacgtcccgaggggaacgggctaggagtggtacttaggaattatcttaagttagtaggccgggtaacgacctaaccgttaactaacgttaacgtcccgttaccctacaaagtacgtaccgaagttaccaacctaattaacgttacccggtaagtaaccaaccgtaactacccgaaaagtaaccctagttcccttacccgttaggacggtcttacggaaccggtccctagggttaccgaacccgtacccggacgtaaccggacctaaccgggtcttacggttaccttagttaaccgtcggttacgacccgaacccctagtaccgtaagttaactccgaagttacggaccgtttaggggttacggttaacggg

SEQ ID NO: 177391 - DNA, 539 bp, Homo sapiens
  misc_feature: GYAE6OF02IY9UK.48.9.A09.1.454.CMB.1.raw
  modified_base (240)..(240): a, c, t, g, unknown or other
  misc_feature (240)..(240): n is a, c, g, or t
  modified_base (352)..(352): a, c, t, g, unknown or other
  misc_feature (352)..(352): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtcccctnacgtgcactgtctctggtgactcatcaacaatagtcattactactggggctggactccgccagtccccgagggagggctggagtggattggaattatctattagtagcggancactatataatccgtcctcaagacgtcgagtcacatactcgtagacacactaccaagaaccagttcctaccctgacgctacgacgccctgtcgaccgcgacagaccacggctgtacctagttactcggtcgaccgtaccctagtccgaattactcgtacgttagaccgtttggttaggttaaccggg

SEQ ID NO: 177392 - DNA, 429 bp, Homo sapiens
  misc_feature: GYAE6OF02H6X2V.48.9.A09.1.454.CMB.1.raw
  modified_base (418)..(429): a, c, t, g, unknown or other
  misc_feature (418)..(429): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctctgcaaggcctctggttagaccttcaccgccgactccagactctggcttccaccaagggcccatcggtcctccccctggccgccctgcctccaggagcacctcgtgggggcacgagcggccctgggctgccgtggtacaaggactacttcctatgtatactctgagcgggctggcaaggcgcagtagnnnnnnnnnnnn

SEQ ID NO: 177393 - DNA, 522 bp, Homo sapiens
  misc_feature: GYAE6OF02GO0YT.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccagggactggtgaagccttcggagacccctgtcccctcacgtgcactgtctctggtgactccatcaacaatagtcattactactggggctggatccgccagtccccagggaaggggctggagtggattggaattatctattatagcgggagcactactataatcccgtcctcaagagtcgagtcacatactccgtagacacactaccaaagaaccagttcctcctgaggctggacgccctgtcgacccgccgacacgacgacggctgtcttattacgtgtcgccgacccatcgatactcatcgacttggttgtacggg

SEQ ID NO: 177394 - DNA, 468 bp, Homo sapiens
  misc_feature: GYAE6OF02FHWJC.48.9.A09.1.454.CMB.1.raw
  modified_base (443)..(444): a, c, t, g, unknown or other
  misc_feature (443)..(444): n is a, c, g, or t
  modified_base (446)..(468): a, c, t, g, unknown or other
  misc_feature (446)..(468): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggccttccaccaagggcccatccggtccttccccctggccgccctgcctccacggacgccacctcgtgggggcacgacggcggcccgtgggctcggccgtggtccgaaggacctacttcctagtgtactactctgacggcggggtcgtcggcgaacgggcgcgatagnngnnnnnnnnnnnnnnnnnnnnnnn

SEQ ID NO: 177395 - DNA, 504 bp, Homo sapiens
  misc_feature: GYAE6OF02HQCKK.48.9.A09.1.454.CMB.1.raw
  modified_base (419)..(419): a, c, t, g, unknown or other
  misc_feature (419)..(419): n is a, c, g, or t
  modified_base (467)..(467): a, c, t, g, unknown or other
  misc_feature (467)..(467): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggagggctggagtggattggaattatctattatagcgggagcacctactataatccgtccctcaagagtcgagtccaccatatccgtagacacatccaagaaccagttcncctgagctgacgccctgtcgaccgccgcacgacacgctgtctattacngtcgccgaccatcgatactcatgactggttgtacggg

SEQ ID NO: 177396 - DNA, 582 bp, Homo sapiens
  misc_feature: GYAE6OF02FID50.48.9.A09.1.454.CMB.1.raw
  modified_base (359)..(359): a, c, t, g, unknown or other
  misc_feature (359)..(359): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtccgggcccagggactgggtgaagccttcggagacccctgtccctcacgtgcactgtctctggtgactccatcaacaatagtcattactacgtggggctggatccgccagtccccgagggaaggggctgggagtggattggaattatctattatagcggganctacctactataactcccgtccctcaagtagtcgagtcacctataactccgtagaccacactaccaaagtaacctagttccctccctaggacgtctaggacgccctaggtcgacccgccggactacgacctacggcttgtaccttacgttaccgtggtcggaccgtaacccctagttaccgtaattactaccaagttcggtacgttgggtttagttaccgggg

SEQ ID NO: 177397 - DNA, 571 bp, Homo sapiens
  misc_feature: GYAE6OF02IOCYK.48.9.A09.1.454.CMB.1.raw
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (433)..(433): a, c, t, g, unknown or other
  misc_feature (433)..(433): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtcccctcacgtgcactgtctctggtcgactccatcaacatagtcattactacgtggggctggactccgcacgtccccgagggagggctggagtgatggaattatctatatagcggancactactataactccgtcctanaagngtcgagtcaacctatactaccgtagaccatactaccaagaacctagttcctacccgngacgtctgaccgtcctggtcgacccgccgacaacgaccgacggtcttacgttactacgtttaccgtggtcgacccgtaaccctacgtccgtaattacgttcgtacgtacggtaaccgtttcgggttaggttaccgggg

SEQ ID NO: 177398 - DNA, 588 bp, Homo sapiens
  misc_feature: GYAE6OF02F7BV8.48.9.A09.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattattggcctggtaccagcagagcctggccaggctcccgaggctcctcatctctgctgcatcctacgngggccatggcactcccagcaggttcagtggcaggtgggtctgggacngtacttcacttctctcatcacgcagacgtggacgtccgtagtaagtattttcgacttaatttattacttacgtaccacctagttagttaggtacgtccttacgtaccttacgttaaccgtttcgggacgggtacgggtaaccgtagggtacggtacggtaacgtaacgaaaccgtaacgttacggtacggtacgttacggacctaaccgtacgttcgttacgttaccg

SEQ ID NO: 177399 - DNA, 1000 bp, Homo sapiens
  misc_feature: GYAE6OF02FU7EX.48.9.A09.1.454.CMB.1.raw
tcagagtatacatacacgaccggtgctcgatttagcgagacgcgcaggggcagggtgtacacctgtggttctcggggctgccctttggcttttctggagagtcagtggactcactagttgtgacaaaagtaaaataggaacgacctaccgttggttcggtttcctttccctccgtggtcgttggggtcgggccggtccctacccgaagtaggttccggggttccctccgtacccggtagggtcgacgacggtcgtcgacggaagggtacgggtcccgggacccgaaggtacgtgggtaagaccgttccggttacgggaccgtaccccgttcgtcccctaccgaccgtcgacctaccgttcgttccttcggtggggtcggtccctaccgtataccgacgccgacgacgtacggtttaaccttttaccgtttcggggtacggggtcgtagggtaccgttcccggacccgaccccggaccccccggggaagggggggtaaccgggtccggttacggggtacgggtagggttacgggttacgggggtaagttttaaacccgtttaacccgaacggtagggggtacggggtaacggaccccgttaaacccgttaacccgtaaaacccccgttaaaccccccggttacccccgttaaaagtaaaacccggtaccgggaacccggtaccctaaacccgtaaactttaaccggttaccccggtaaacgaacccgtaccccgtaaacccgaaaacccggtaaaacccttaaccgtttaccccgtcccggttaaacggacgtaccgttagaccgttccttccgttaggtacccggacccggtacggacccaacggacccgtaccggtcgtacgttttaaccgttaacgtttaccgtgggaccggtaacccgggaccccgggtacccggacggtaccccggacggtttaacggggttccgttttacgggttttttacgacggtttcccggttttaccgtttaggttaacgg

SEQ ID NO: 177400 - DNA, 563 bp, Homo sapiens
  misc_feature: GYAE6OF02FF50G.48.9.A09.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (435)..(435): a, c, t, g, unknown or other
  misc_feature (435)..(435): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccactggacaaatagtgatgacgcagtccccagccaccctgtctgtgtctccaggggaanagtcaccctctcctgcagggccagtgagagtcttgacagctccttagcctggtaccaanaaacggcctggccagccctccccaggcctcctctatttangatacatccaccgagggccacgtggtcgtcccagccaggttcacgtgggcggtgggtctgggacaggtgttcacttcacaccatcagtcagcctgactagtctagtaactattttacattttatactgtacagntagtatacgtagtggtacctccgtacggtttcgaccgaagggtaccgtaagggtcgaagtacgaaacggtacgttggtaggacctgacctacgtagttcgtacgttccttacacgttcccttaccccg

SEQ ID NO: 177401 - DNA, 522 bp, Homo sapiens
  misc_feature: GYAE6OF02JPB8U.48.9.A09.1.454.CMB.1.raw
  modified_base (333)..(333): a, c, t, g, unknown or other
  misc_feature (333)..(333): n is a, c, g, or t
  modified_base (491)..(522): a, c, t, g, unknown or other
  misc_feature (491)..(522): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccaggtgcacggtggggcagtcgtggggctggaagtgaagaggcctggggcctcaggtgaaggtctccgtgcaaggcctcgtggttacgtaccttcgaccgccgacctccagactctacggccttacccgaccgtaacgggccccaagtccggtccttcccccgnggccgcccctcgcctccgaggcgccaccgtcgtcggggcacgacggtccgcccgtgggctcggccgtggtacgaaacggacttaccgttcgtaacgtgtaaccgttacttcgtcggtaacggccgggtctacgggacgaacggccgacgtaagtacgnnnnnnnnnnnnnnnnnnnnnnnnnnnnnnnn

SEQ ID NO: 177402 - DNA, 523 bp, Homo sapiens
  misc_feature: GYAE6OF02IBSB7.48.9.A09.1.454.CMB.1.raw
  modified_base (239)..(239): a, c, t, g, unknown or other
  misc_feature (239)..(239): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctnacgtgcactgtctctggtgactccatcaacaatagtcattactactggggctggactccgccagtccccagggagggctggagtggattggaattatactattatagcggagcactactataactccgtccctcaagtagtcgagtcaccatatccgtagacacataccaaagaacctagttcctaccctgacgtctcgagccctgtcgacccgccgcgacgacgacggctgtctacttacgtgtcgccgacccatcgatactcattcgattgggttgtacggg

SEQ ID NO: 177403 - DNA, 599 bp, Homo sapiens
  misc_feature: GYAE6OF02JYQZA.48.9.A09.1.454.CMB.1.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagatacccactggacaaatagtgatgacgcagtccccagcccaccctgtctgtgtctccgaggggaaangtccaccctctcctgccgagggccagtcgagagtcttgacagctctagcctgaccanaagcctgccagcctccaggcctcctanattatgactacntaccaccgagggccacgtggtctcccaagcctaggttccacgtggcggtgggctgggacaggagttcacttcctacacctatcagccgagcctgtcagttctacgaagttattttaacattttactacgtgttacactataacggttattaccggtagttcggtaccttaccggtacgttttacggaccgtaaagggtacccgtaaggtcggaagttaccaaacggttacgtggttacggacgtcggtacctaaccgtatttccgacggtttaccttagtccttaacccgttccccg

SEQ ID NO: 177404 - DNA, 705 bp, Homo sapiens
  misc_feature: GYAE6OF02IJK9E.48.9.A09.1.454.CMB.1.raw
  modified_base (360)..(360): a, c, t, g, unknown or other
  misc_feature (360)..(360): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtgttcttcctctgctggtggcggctcccagatgggtcctgtcccaggtgcagctgcagggagtcgggcccaggactggtgaacgccttcggacgaccctgtccctcacgtgcactgtctcgtggtgactccatcaacaatagtcattactactgggctggactccgcacgtcccgagggaggctggagtggagttggtaattatcttaagttatacggcgggtanacgtaccgtaactaactaacgtcccgtaccctacaaagtacggttccgagtaccaaccctaagtaactcccggtaagaaccaacgtaactacccaaagtaaacccctacggttttaccctccccgttaggtaaccgggtacctacggtaaccgtcccccgttagggtacccgaaccccggtacccggacgtaacggtacccgtaaacccgggtccttacggtttacccgttacgttttaacccggtacggttaccgggtacccgtaacccccgtaagttacccgtaaagttacctccggtaaaccgttacgggtaacccggtttggttttaacgggttaccgggg

SEQ ID NO: 177405 - DNA, 585 bp, Homo sapiens
  misc_feature: GYAE6OF02IE15I.48.9.A09.1.454.CMB.1.raw
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcggggcccagggactggtgaagccttcgggagaccctgtccctcacgtgcactgtctctggtnactccatcaacaatatcattactactggggctggatccgccngtccccgagggacgggctgggagtggattggtaattatcgtaattagtagcgggagcacctactataactcccgtcctcaagtagtacgagtccaaccatactccgtagaccacgaactaccgaaagtaaccctagtttacctcccgtagacggtctaggcgcccgttaggtcgacccgccgacgacgaacgcggtctcgtacttacgtttacctggtcgcccgtaacccgtagtaccgtattacgtactacttaggtaccgttgggttaggttaccgggg

SEQ ID NO: 177406 - DNA, 525 bp, Homo sapiens
  misc_feature: GYAE6OF02ITXF3.48.9.A09.1.454.CMB.1.raw
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
  modified_base (467)..(467): a, c, t, g, unknown or other
  misc_feature (467)..(467): n is a, c, g, or t
tcagagtatacatacacgaccggtgctcgatttagcgagacgcgcagggggcaggatgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggactccgccacggtccccgaggggaacgggctggagtggattggaattatctattatagcgggancacctactataactccgtcctacaagagtcgagtccaccatactccgtagacacactaccaaanaacctagttcctcctgacgctgacgcctgtacgaccgcgcagacncgtctgtctatacgtgtcgcaccctatccgtatactcctagtcgtacgttggttacgg

SEQ ID NO: 177407 - DNA, 619 bp, Homo sapiens
  misc_feature: GYAE6OF02HOX6M.48.9.A09.1.454.CMB.1.raw
  modified_base (354)..(354): a, c, t, g, unknown or other
  misc_feature (354)..(354): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactacgtggggctggactccgccagtccccgagggagggctggagtggattggaattatctattagtagcgggancactactataactccgtacctcaagagtcgagtccacatactccgtagacacataccaacgaacctagtttccctaccgttaggacggtctacggaacgtccccgttaggtccggacccggccgaccgaacggacccgaaccgggaccttcgggttaccttaacgtttccgttacgggttccggccccgtaaccccgtacgtaccgttaacttacgttacctaacgttcggtaaccgttttgggggtttacggttaacccggggg

SEQ ID NO: 177408 - DNA, 639 bp, Homo sapiens
  misc_feature: GYAE6OF02GK8RU.48.9.A09.1.454.CMB.1.raw
  modified_base (423)..(423): a, c, t, g, unknown or other
  misc_feature (423)..(423): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcggccaggactggtgaagccttcggacgaccctgtccctcacgtgcactgtctctggtgctcatcaacatagtcattacactgggctggactccgcacggtcccgagggacgggctggagtggtatggtaattactcttaattagaggtcgggacgtctaacctatactaaacgtcccgttaccctacgaacgtacgtacgacgtacacctatacgtcccgtaanactaaccaattacccaaacgtaaaccgttacgttacccttacccgtaggtacggtcctacgggacgtccccgttagtacccgaacccggcccgacgtaacggaacccgtacggtccgttcgtaccttacgtttactacgggttacgacccggtaaccctacgttaccgaacttacgtacgtaactcggttacgtttcggggttacgttaaccgggg

SEQ ID NO: 177409 - DNA, 519 bp, Homo sapiens
  misc_feature: GYAE6OF02HLC7X.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggtggctcccagatgggtcctgtcccaggtgcagctgcaggagtcgggcccaggactggtgaagccttcggagaccctgtccctcacgtgcactgtctctggtgactccatcaacaatagtcattactactgggctggatccgccagtccccagggaagggctggagtggattggaattatctattatagcgggagcacctatataattcccgtccctcaagagtcgagtcaccatatccgtagacacatccaaagaaccagtttcctaccctgacggctagacgcccgtgtacgacccgccgacacgacacggctgtctattactgtcgccgaccatcgatatcatcgacttggttgttacggg

SEQ ID NO: 177410 - DNA, 579 bp, Homo sapiens
  misc_feature: GYAE6OF02GBW09.48.9.A09.1.454.CMB.1.raw
tcagagtatacatacacgaccggtgctcgatttagcgagacgcgcaggggcagggtgtacacctgtggttctcggggctgccctttggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggatccgccacgcccccgaggggaaggggctgggagtggagttggggagttacttaaccgacgtaggtgggagcgacctaacgtaccaacccgtccctacaaaacgtcgaggaccaccgatactccgtaagaccgtacgtacccgaaacgaaccctaaacgttccgtacccttaggaaacgtcctagacgtcctacgtcgtacgacccgccgcgaacgaccgacgtctgtctattcgtgtcgcggacggccccgagccgcgtggtggttctttggactcgttcttag

SEQ ID NO: 177411 - DNA, 614 bp, Homo sapiens
  misc_feature: GYAE6OF02HOLPK.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaacgccttcggacgaccctggtcccctcgacgtgcacgtgtctctggtgactccatacaacaatagtcattactacgtggggctggactccgccacgtccccgaggggaacggggctagggagtggagttggtaattagtacttatagtaggcgggagactaactactataactccgtaccctacagacgtacgactaccaactagttactaccggtagacctaactactaaccaacgaaccttacgtttccctacccgtgacgtctacgacgtcccgtgccgacccgccgacgagaccgcggtcttacgttctaacgttcgttacggccgtacccgaccgtacgttaccggtaattacgacgttagtaccgtacggtttacgggttaggttaaccggg

SEQ ID NO: 177412 - DNA, 656 bp, Homo sapiens
  misc_feature: GYAE6OF02GIVAA.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctcgtggtgactcatcaacaatagtcattactactgggtctggactccgccacgtccccgagggaacgggcgtaggaggtggagttggaattagtctattagaggcggagcactactataactcccgtcctacgaagtacgtacgagtaccgacctaattacgtccgtaagaccaacaacttaccgaaacgtaaaccctacggtttccctacccgtaggaacgggtccttaggaccggtccccttagggtacccgtacccggacccgtacgaacggaacccgtacggtccttagggttaccttaacgtttaccgtcggtttccgggaacccgtaacccgtactaccggtaacttagttaccgtaagttaccgggtttaccgtttggggtttacggttaaccggggg

SEQ ID NO: 177413 - DNA, 523 bp, Homo sapiens
  misc_feature: GYAE6OF02F4ZRZ.48.9.A09.1.454.CMB.1.raw
  modified_base (378)..(378): a, c, t, g, unknown or other
  misc_feature (378)..(378): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaagccttcggagaccctgtccctcacgtgcactgtctctggtgactccatcaacaatagtcattactactggggctggatccgccagtccccgagggaacgggctggagtggattggaattatctaattatagcgggagcacgtactataatccgtccctanaagagtcgagtcaccatactcgtagacacataccaaagtaaccaagttctaccctgacgctagacgccctgtcgaccgcncagcacggctgtactattacgngtcgaccgaccatcgaatctacatagacgttggttggttacgg

SEQ ID NO: 177414 - DNA, 544 bp, Homo sapiens
  misc_feature: GYAE6OF02HKQBR.48.9.A09.1.454.CMB.1.raw
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggactccgccagtccccgagggaaggggctgggagtggattggaattatactattatagcgggancactactataactccgtacctcaagtgtcgngtaccacatacgtcgtagacacactccaaagtaacctcgttaccctcccgtagacggtctagacgccctaggtcgacccgccgcacgaccgcggctgttctattctggtcgaccacctaatccgattactacacgtgtacgttggtcggttacggg

SEQ ID NO: 177415 - DNA, 638 bp, Homo sapiens
  misc_feature: GYAE6OF02IUSIY.48.9.A09.1.454.CMB.1.raw
  modified_base (377)..(377): a, c, t, g, unknown or other
  misc_feature (377)..(377): n is a, c, g, or t
  modified_base (495)..(495): a, c, t, g, unknown or other
  misc_feature (495)..(495): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggctgggtgaacgccgttcggacgtacccctgtcccctgacgtgcactgtctcgtggtgactccatcaacatagtcattactacgtgggactggtactccgccacgtccccgagggaacgggctgggagtcggtagttaggaattagtacttagttagtaaggcgggtacncgtaaccttaacgtaacgtaacgtaccgtaccccgtagtaaacggtacgtacggacgtccaccgtaatacgtcgtaagtaaccactaacgtaccaaacgaacctacgttaccctaccnggtacgtctaggacgcccgtagtccggacccgccgtaccgtaacgaccgtacggcgttacgttcctacgttaccgtcgtccggacccgtacctacgttacgacgttataccgtaatcggtacgttagggttaggttacccggg

SEQ ID NO: 177416 - DNA, 624 bp, Homo sapiens
  misc_feature: GYAE6OF02I6I45.48.9.A09.1.454.CMB.1.raw
  modified_base (241)..(241): a, c, t, g, unknown or other
  misc_feature (241)..(241): n is a, c, g, or t
  modified_base (358)..(358): a, c, t, g, unknown or other
  misc_feature (358)..(358): n is a, c, g, or t
  modified_base (553)..(553): a, c, t, g, unknown or other
  misc_feature (553)..(553): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggacgaccctgtccctnacgtgcactgtctctggtcgactccatcaacaatagtctattactacgtggggctggatccgcacgtccccgaagggacgggctggagtggattggaattatctatagtagcggtanctaccgtactaataacgtcccgtaccctacgaaacggtaccgtacgtacgtaccctaaacccgagtttaacgtacccggttaaacgaaccctaaccgtaataccccgaaaacggtaaccccttaaggttcccttacccgtgaccggtcgtacgaacgtccctggttacgaccgccggtacacgtacgaaccggtntacgtactacttccgtgtacggaccacccgtgtaccgtatacgttcaagtcgtacgttcggttagtaccgg

SEQ ID NO: 177417 - DNA, 559 bp, Homo sapiens
  misc_feature: GYAE6OF02GX0GJ.48.9.A09.1.454.CMB.1.raw
  modified_base (374)..(374): a, c, t, g, unknown or other
  misc_feature (374)..(374): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccacgtccccgagggagggctggagtggattggaattatctattatagcggagcacctactataactccgtcctanaagagtcgagtcacatactccgtagacacactaccaagtaaccctagttcctaccctgaacggtctgacgcccgtagtcgacccgccgacgacgacgaccggtctcgtacgttattaccgtcgtcgacccgaaccctagtaccgtattactcgtagttacgtaccgtttgggtttgttaacgggg

SEQ ID NO: 177418 - DNA, 778 bp, Homo sapiens
  misc_feature: GYAE6OF02IB4OE.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcgctcccagatgggtcctgtcccaggtgcagctgcagggagtccgggccaggactggtgaacgccttcggacgtaccctgtcccctgacgtgcctactgtctctggtcgactccaatcaaacaattacgtactactttaacgtacggtcggggtcgtcggtaacgttcccggacccgtacggtacccccgaagggggtaacggggtacgtaggggtaacggtgggtaagtttagggtaactttagtaccgtttaagttaagtaacgggaccggggtacgtaccgttaaacccgttaacgttaacgttaacctaccccggttcccttaacggtaaacggtacggttaccggtaacggtacctaaacccgtaattaaccgtacccgttaacgaaccgtacctaactaacccgtaaacgtaaacccgttacgtttaccctacccggtaggtacggcgtacggaaccgtccctagggtaccgaccccgtaccgacgtaacggacccgtaacggccttacgttaccttagttacgttacggtccggaaccccggtaccctacggttaaccgtatttaccgtacgtaacggttaggttaccgttttacggggttaggttaacccgggg

SEQ ID NO: 177419 - DNA, 611 bp, Homo sapiens
  misc_feature: GYAE6OF02IFMOT.48.9.A09.1.454.CMB.1.raw
  modified_base (361)..(361): a, c, t, g, unknown or other
  misc_feature (361)..(361): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtccccaggtgcagctgcaggagtcgggcccaggactggtgaagccttcggacgaccctgtcccctcacgtgcactgtctctggtgactccatcaacaatagtcattactactggggctggactccgccagtccccgagggaacgggcgtggagtggattggaattatcttattagtaggcggganactactaatactaatcccgtacctacaagtgtcgatcaactatactaccgtagaccactactaccaaggaacctacgtttcctccgtgacgtctcgacgtcccgtagtcggacccgaccgtcgaacgaccgtacggcctacgttaccttacgtttaccgttggacggtacccgtacccgtaacgttaccggaatttaacgttccgtaaagtttcgggtaaccgttttcggggttacgggtttaaccgggg

SEQ ID NO: 177420 - DNA, 716 bp, Homo sapiens
  misc_feature: GYAE6OF02I2J0I.48.9.A09.1.454.CMB.1.raw
  modified_base (547)..(547): a, c, t, g, unknown or other
  misc_feature (547)..(547): n is a, c, g, or t
tcagagtatacatacacgaccggtgctcgatttagcgagacgcgcaggggtgcctggagactgcgtcaacgacaatttccccagagggaaccatggaaacccagcgcagtcttctcttcctctgctactctggctccagactaccaccggagaaattggttgttcgacgtcagtctccaggcacctgtctttgtctccgagggaaacgcgccctacctctaccgtgcgacgggccagtcgagtactacgttactgttaaacttagttacggactacggtaacctagtccgtaaggtaaccgaccgttacggaacctaacggtaccttacccgaacggtcctaccgtactacttcgtactcggaccttaggccgtactaccgtaacggacggtccgtaacggtccggtactaacgtacccggaacgtacgtacgggtaccagggtccggtacgtagggtacggttacgtacgggactacgtacctactacgtccgtactacctacgttcgacgtacgtacggtactcgggactacgtaagtaccgttntttacgactttaatttacgacgtacgtaccgttaatagttaacggttcggttacgcttacctacgttacgttaccgtagggacgtaaccggtagtacgtacgtaacgtacaaccggtaagtcgttaccggtgtacctacgttaccgaagtttcccgtattccggtaacc

SEQ ID NO: 177421 - DNA, 691 bp, Homo sapiens
  misc_feature: GYAE6OF02F705X.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcgagggagtccgggcccagggactgggtgaagccttcgggacacccctgtcccctcacgtgcactgtctctggtgactccatcaaacatagtcattactacgtggggctggactccgccacggtccccgaggggaagggctggagtggattggaattatactatagtaggcggagcacctataataacttcccgtacctagaacgacgtcgagttacgaacctaatacgtaccgtagaaccacaactacccaaacgtaaccgtacgtttccctacccgttaggacggtcctacgggaccgtaccccggttacggttccggaccccggtacccggtaccgaaccggaacccgtaccggggtcttacggttacctttacgtttaccggttacggttccggaaccccttaaaccccgggtacgttaccggttaaagttaacctttaccgtaaaccggtttagggaaccggtttttcggggggtttttacggttaacccggggg

SEQ ID NO: 177422 - DNA, 681 bp, Homo sapiens
  misc_feature: GYAE6OF02GWFGH.48.9.A09.1.454.CMB.1.raw
  modified_base (249)..(249): a, c, t, g, unknown or other
  misc_feature (249)..(249): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaacgccgttcggacgaccctcgtccctcacgtncactgtctctggtgactcatacaacaatagtcattactacgtggggctggactccgccacgtccccgaggggaacggggctgggagtggtagttaggtaattacgtacttagttaagtaggacgggtaacgacctaacgtaaccttaataaccgttccccgttaccctacgaacggtacgtaccggtacgtaccaaccctaattaaccgttacccgtaacggtaaccaacctaacgttaaccccgaaacgtaacccgttacgtttccctaccccgttaggacgggtacctaggacccgttcccgttggtacccggacccgcccggacgaccgaaccgaccggtacgttcgttacttacttccgtgttaccggacccgtaacccagttaccagttacgtacctagtacgtacggtttagggtaccgttacggg

SEQ ID NO: 177423 - DNA, 680 bp, Homo sapiens
  misc_feature: GYAE6OF02I0UCV.48.9.A09.1.454.CMB.1.raw
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
tcagagtatacatacacgaccggtgctcgatttagcgagacgcgcaggggcagggtgtacacctgtggttctcgggctgccctttggctttctgagagtcatggatcacatgtgacaagaaatgaagcactgtgttctctcctgctggtggcgctcccagatgggtcctgtcccaggtgcagctgcaggagtcggccaggctggacgacgtccttcggacgaccctcgtcccctanaccggtgacctacgtgtcctcgtcggtcacttcctaanaccctaaataatacgtactaagtttaccacgttcgggctagggactccgaccgaccgtcccgagggtacgggcgttagggacgttagggacgttaggtaaatttactacgttaaagtttaggaacggtcgggtaacgacccgtaacgttaacgtaacttaacgtcccgttaccctagaaacgtacgtacgacgtacaacgtactacgtaccgttaagaacctacgtactaaccgaagttaaccagtttaccgtaccggtacncggacgtacganggtaccgtacccgtacgtaccgaccgaccacggaccgtacggtaccgtacgttaccttacgttacgtcgttaccgtacgtacccgtacgttaccgtacgtacgtaccgtacttacggttacgttaggttacg

SEQ ID NO: 177424 - DNA, 567 bp, Homo sapiens
  misc_feature: GYAE6OF02HFVXM.48.9.A09.1.454.CMB.1.raw
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
  modified_base (452)..(452): a, c, t, g, unknown or other
  misc_feature (452)..(452): n is a, c, g, or t
tcagagtatacatacacgaccggtgctcgatttagcgagacgcgcagggcacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaacggcccgggggctcgtgtgtagggtttcagtgcgaaggcctcgtggatactcgttcacaacctacactatcgcagttgggngcgccgacggcccccgganaagtccttgagtggngtggggtgctacgacgcgtggcgagtggtcagaactaaagtnttacacgtagtacgttccgaggacagacgtacaccatacaccgaggaccacgtccgngacgttagtgttctcgagtggactcgtgcgcgagttctggagtacggtacggacgacgacggctacggtattacgttacgtgtacggacggtaggagggtcgtagttagttcggg

SEQ ID NO: 177425 - DNA, 648 bp, Homo sapiens
  misc_feature: GYAE6OF02FJU24.48.9.A09.1.454.CMB.1.raw
  modified_base (475)..(475): a, c, t, g, unknown or other
  misc_feature (475)..(475): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtccgggcccaggactgggtgaagccttcggacgacccctgtccctcacgtgcactgtcctctggtgacctccatcaacaatagtcattactacgtggggctggactccgcacgccccgaggggaacgggctggagtggattgggaattatacttattaagtaggcgggacacaaccttactaactaacgtcccggtccctacaaggtacgtacggatccaacccaattctaccgtaagacaacactacccaaagaacccttagttcccttccgtaggngtaccgtcgaccgtccctaggttaccgacccggacccggacaacggaccgtaccggtcttcgtactttacccgttacggtcggtaccggacccgtaaccccgtacgttaaccgttaacttaacgttacctaagttacggttacgttttacggggtttaccgggttaaccgggg

SEQ ID NO: 177426 - DNA, 682 bp, Homo sapiens
  misc_feature: GYAE6OF02G2BEN.48.9.A09.1.454.CMB.1.raw
  modified_base (241)..(241): a, c, t, g, unknown or other
  misc_feature (241)..(241): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcagggagtcgggcccaggactggtgagtccgttcggagaccctgtccctnacgtcgcactgtctcgtggtcacctccatacaacaatagtacctattacgtacgtggggctggactccgccacgtaccccgaggggacggggctgggagtggtagttaggaattactacgttattaggtaggcgggtagtaccgtaacctaacgttaacgtaaccgttccccgtaccctacgaacgtacgttaccggagtacccaaccgtaagttaccgtaccggtaacgaaccaacgtacgtaacccgaaacgtaaacccgtacggttaccctcccgtaggacggtccgtagaccgtccccgtaggtcccggacccggtccgaaccgaggaacccgtacggtcttaccgttactttaacgttcgtcggtaccggtacccaacccgtagttaccgtaattacgtacgttagtaccgttcgggtttaggttcggttaacggg

SEQ ID NO: 177427 - DNA, 588 bp, Homo sapiens
  misc_feature: GYAE6OF02FVLOJ.48.9.A09.1.454.CMB.1.raw
  modified_base (204)..(204): a, c, t, g, unknown or other
  misc_feature (204)..(204): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccgaggggaaanagccaccctctcctgcagggccagtgagacagttactgttaattagttcggccttggtaccagcaagaagcctggccaggcctcccgaggcctcctcactctctgctgcactcctacgacgggccacgtggacctactcccaaggactaggttcaggttcggactagggtgggtcgtagggacagtacttcacgtcctctccatcagcaagcgtggacgccgtagaagttatttcgaacttaattttacgtacgtgtacctacgtaagttgtacggtactctacctaccttacgttaacgttcggacggtacggacgtaggtacgaggtactaaccggaaacgtacgttgaggtctacggtacctaccgtgttacgtcgttacc

SEQ ID NO: 177428 - DNA, 563 bp, Homo sapiens
  misc_feature: GYAE6OF02FTV4H.48.9.A09.1.454.CMB.1.raw
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (516)..(517): a, c, t, g, unknown or other
  misc_feature (516)..(517): n is a, c, g, or t
  modified_base (520)..(521): a, c, t, g, unknown or other
  misc_feature (520)..(521): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggacgcccactgccaggtgcacggtggggcagtcgtggggctggaagtgaagacggccgtcggggcctcgagtgaaggtctcctgacgaaggtcctttggttacaccttccaccgccgtactccagactcgtacggccttccaccgaacgggcccacgtccggtccttcccccgcggccgccctcgcctccgaggacgccaccgtcgcgggggccacgacggccggtcccgtgggcgtcgccgtggtacgaacgggtacttaccttccgtattacgtactacttcgtacgtacgggccgggtcgtacgggaccgaagggtccgactacgttaggactgactcganacgtcancgcncgnngcnngcagagacncgagcncacgacncgacgngcncngananannc

SEQ ID NO: 177429 - DNA, 498 bp, Homo sapiens
  misc_feature: GYAE6OF02HYOEY.48.9.A09.1.454.CMB.1.raw
  modified_base (469)..(498): a, c, t, g, unknown or other
  misc_feature (469)..(498): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactgccagggtgccacgtggggcagtcgtgggggctgaagtgaaggaggccgtggggcctcgagtgaaggtctctgacaggctctggttacgactttccaccgccgactccacgactctggcttcccaccaacgggcccacgtccggtccttcccccgtcgggccgccccgtacgcctccacggacgcctacctcgacgggggtacaaacggccggcccgtgggctcggccgtcggtacaacggtactacctttacctagtagttactactcgtggaggcggtcgtggacgagggcgcagtagcnnnnnnnnnnnnnnnnnnnnnnnnnnnnnn

SEQ ID NO: 177430 - DNA, 594 bp, Homo sapiens
  misc_feature: GYAE6OF02FO25W.48.9.A09.1.454.CMB.1.raw
  modified_base (325)..(325): a, c, t, g, unknown or other
  misc_feature (325)..(325): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcacctgtggttctttcctcctgctggtggcggctcccagatgggtcctgtcccaggtgcagctgcaggagtcgggcccaggactgggtgaagccttcggacgacccgtcgtcccctcacgtgcactgtctctggtgactccatcaacatatcattactacgtggggctggactccgccagtcccgagggaggggcnggagtggattggaattatactattataggcggacgacacctaactaacttaacgtccgtaccctanaacggagtacgagtcaacctatactcccggtaanaccaacattacccgaaacgtaaaccctacgtttccctacccgtaggacggtacgtacggacggtccccttggtcgacccgccgtacgacggtaccgacggtacttcgtacttagtacgtggtcgaccgaccctatccgatactacgtatcggtacgttgggttgtacgg

SEQ ID NO: 177431 - DNA, 788 bp, Homo sapiens
  misc_feature: GYAE6OF02H4R2U.48.9.A09.1.454.CMB.1.raw
  modified_base (168)..(168): a, c, t, g, unknown or other
  misc_feature (168)..(168): n is a, c, g, or t
  modified_base (253)..(253): a, c, t, g, unknown or other
  misc_feature (253)..(253): n is a, c, g, or t
tcagagtatacatacacgaccggtgctcgatttagcgagacgcgcaggggcagggtgtacacctgtggttctcggggctgccctttggctttctgagagtcatggatcacatgtgcaaagaaaatgaagcacctgtggttcttcctcctgctggtggcggctcccagntgggtcctgtcccaggtgcagctgacagggaggtcccgggcccagggactggtgaacgtccttacgggacgaccctcgtcccctnacgtgcactcgtctcgtggtcgcctaccaactacaaactaattagtactacttactacggtcggggtacgtaggacctccgaccgaccggtaccccggagggggaacggggtcgtcgggaggttagggtagttacggtaaatttacgtacgtttaattaggtacgggtacggggacgtaccctaaccgttaaaccttaacgttaaccgtttccccgttacccgttacggaaacggttacggttaaccggtagttaccccaacctttaaacgttccgtttaaacccgggtacgtaaccaaccggtaactaacccccggaaaacgttaacccggttacgttccttacccgacggtacggtccgtacggaccggttccctaacgggtcccgaccccgtcggaaccgaccggtaccgaaccggttcgttacgtttaccttaccgttcgttccgggtaacgtaccccgtacgaaccgtttccgaactttctaacccgtgttacccgggttaacggttttcgggtttaacggttaccgggg

SEQ ID NO: 177432 - DNA, 764 bp, Homo sapiens
  misc_feature: GYAE6OF02IGQUC.48.9.A09.1.454.CMB.1.raw
  modified_base (112)..(112): a, c, t, g, unknown or other
  misc_feature (112)..(112): n is a, c, g, or t
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
  modified_base (258)..(258): a, c, t, g, unknown or other
  misc_feature (258)..(258): n is a, c, g, or t
  modified_base (564)..(564): a, c, t, g, unknown or other
  misc_feature (564)..(564): n is a, c, g, or t
tcagagtatacatacacgaccggtgctcgatttagcgagacgcgcaggggcgagggtgtacacctgtggttctcggggctgccctttggctttctgagagtcatggatcacntgtgcaagaaatgaagcacctggtgttcttcctcctgctggtggcggctccagntgggtcctgtcccgaggtcncgagctgacagggacgtccgggccaaggctgggtagaacgtccttacgggaacgtcccgttgtccccttacnccgtggcctacgttgttccgtccgttgggacgaccttcccattaccaaaacggtaattacggttacctaactttaccgtaacggttcggggtacttggtaacctacccggcctaccggtaacccccggaggggaaacggggcttggggtacgttacgggattacgggtaaacttgtaccgtttaattaaaggtcggggacgggtaaacggtacctaaccttaaacgttactaaaacgtttcccccggtaccgttaacgaaacgggtaacggttccgtaacgtcaaccgttataacgttcccgaaanacgtaactacgtacctaaacgtaaccttacgttcctccggtacgacggtacaccgtaccggtccgttacggaaccggtcccgtaaccgacgtaaccgtaccggtacggttctaaccgtttacgttacgttacgtccggaaccgtccgtaaccgtacgttacgaattctacgtaccgttcggttcggttaggttcggtacg

SEQ ID NO: 177433 - DNA, 707 bp, Homo sapiens
  misc_feature: GYAE6OF02FQO6D.48.9.A09.1.454.CMB.1.raw
  modified_base (493)..(493): a, c, t, g, unknown or other
  misc_feature (493)..(493): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggtcttcctcctgctggtggcggctcccagatcgggtcctgtcccaggtgcagctgcagggacgtccgggacccaggacgtgggtagaacgtcccgttacggacgaccccttcgtcccctcgaccgtcgaccacgttcgtctcgtggtcgacctccactacaaacaagtacgtctattaccgtacgtggggctggcgtccgccgaccggtcccggaggggacgggcgtagggacgtaggtagttaggtaacttagtacttagttacgtaggacggtacgacctaacttactaacgtaaccgttcccgtacccgtagaacgtacggttacgacgtaccaccgtaattaacgacccgtanaacctacgtaaccgtaaccgaaacgttaaccgttacgttaccctaccggttcggacgtcctacgtaccggttcccgttacggtaccggccccgacggtaccgacgtaaccggccggtacgttaccgttacttacgttcgtacggtccgaacccgtaccctaagtaccgtacttaacgtccgtagtacggttacggtttcggttagggtacccgg

SEQ ID NO: 177434 - DNA, 815 bp, Homo sapiens
  misc_feature: GYAE6OF02IBGE9.48.9.A09.1.454.CMB.1.raw
  modified_base (147)..(147): a, c, t, g, unknown or other
  misc_feature (147)..(147): n is a, c, g, or t
tcagagtatacatacacgaccggtgctcgatttagcgagacgcgcagggggcagggtgtacacctgtggttctcggggctgccctttggctttctgagagtcatggatcacatgtgcaagaaaatgaagcactgtggttcttcctcngctggtggccggctcccagatcgggtcctgtcccgaggtgcagctgcgagggacggtccgggcccaggactgggtagaacgtccgttcgggacgacccttcggttccctacgacggtgtaccacgttcgtccttcgtgggtcgtacctcctagtaccaaactaagtacgtacttaacgttaacgtaccggtgggggtacctacggggtacctcccggacccgtaccgggtacccccggaaggggggtaacggggtcgtaggggtaggttacgggttagttagggtaaatttacgttacgttaagttagtacggggacggtacgaccgttaaaccgttaacgttaacgttaaccgttacccggttacccctaggtaaacgggtacggttaccgtaaccgttaccccgaaaccgttaagtttaaacccggttacccggtaaaggtacccaaccgttacctaaacccgaaaccggtaacctttaccggtttccctaacccggtaggtaccgggtactacgggtactccccggttacggtaccggccccgtaccggtacgaccgtacggaccggttcttacgtacgttactttaccggtgtccggaccctaaccgtacgttaccgtaattacgtacggtacgttggtaaccgtttggggttaccgtacgggg

SEQ ID NO: 177435 - DNA, 686 bp, Homo sapiens
  misc_feature: GYAE6OF02INLVL.48.9.A09.1.454.CMB.1.raw
  modified_base (183)..(183): a, c, t, g, unknown or other
  misc_feature (183)..(183): n is a, c, g, or t
  modified_base (474)..(474): a, c, t, g, unknown or other
  misc_feature (474)..(474): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcgctccagatgggtcctgtcccaggtncagctgcgaggagtccgggcccaggactggtagaacgtccgttcggacgacccgtcgtccctcgacgtgacctactcgtctcgtggtcgactccatacaactatacgtctattacgtacgtgggctcggtactcccgaccacgtccccgaggggtaacgggcgtgggaggttggatttagggaattagtcgttaattagtaggacgggatacctaaccgttaactaataacgttcccgtaccctacgaaggacgttaccgacgttaccgaacctaagtacgtaccggtaanaccgtaccgtaacttaaccgaacgtaaacccgttacgttttcccctacccgttagggacgtacgtccggtaaccgtcccgttacgggacccgtacccgccgaccgaagcccgaaccggtcttacgttaccttacgttacctcggtaccggtacccaacccgtattccgtaatacgtaccgagttacggtacgtttacgggttacgttacggg

SEQ ID NO: 177436 - DNA, 546 bp, Homo sapiens
  misc_feature: GYAE6OF02GMF2J.48.9.A09.1.454.CMB.1.raw
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (496)..(496): a, c, t, g, unknown or other
  misc_feature (496)..(496): n is a, c, g, or t
  modified_base (518)..(518): a, c, t, g, unknown or other
  misc_feature (518)..(518): n is a, c, g, or t
tcagagtatacatacacgaccggtgctcgatttagcgagacgcgcaggggcagggtgtacacctgtggttctcgggctgccctttggctttctgagagtcatggatcacatgtgcaagaaaatgaagcacctgtggttcttcctcctgctggtggcggctcccagatgggtcctgtcccaggtgcagctgcagggatcgggcccagggactgggtgaagccttcggagacccctgtcccctnacgtgcactgtctctggtgactccatcaacaatagcattacacttggggctggatccgccagtccccgagggaacggggctgggagtggatttggaattatctattanagcgggagcactactaacgtaactcccgtaccctacgaagatcgaacgtcacctatactccgtagaccacatccaanaccagttcctaccngacgctgacgccctagtccgaccgccgcgacgacacggctacgtctacgttaccngtcgccgtaacccatccgtatntcctatcggacttgggtacgttacgggg

SEQ ID NO: 177437 - DNA, 687 bp, Homo sapiens
  misc_feature: GYAE6OF02HUPGC.48.9.A09.1.454.CMB.1.raw
  modified_base (145)..(145): a, c, t, g, unknown or other
  misc_feature (145)..(145): n is a, c, g, or t
  modified_base (164)..(164): a, c, t, g, unknown or other
  misc_feature (164)..(164): n is a, c, g, or t
  modified_base (197)..(197): a, c, t, g, unknown or other
  misc_feature (197)..(197): n is a, c, g, or t
  modified_base (411)..(411): a, c, t, g, unknown or other
  misc_feature (411)..(411): n is a, c, g, or t
  modified_base (540)..(540): a, c, t, g, unknown or other
  misc_feature (540)..(540): n is a, c, g, or t
  modified_base (633)..(633): a, c, t, g, unknown or other
  misc_feature (633)..(633): n is a, c, g, or t
  modified_base (656)..(656): a, c, t, g, unknown or other
  misc_feature (656)..(656): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaatgaagcacctgtgttcttcctcngcgtggtgcgactccgagntcgggtcctgtcccgaggtgcagtctgcagggngtccgggaccaggacctggtagaacggtccgttacgggacgtacccttcgtcccttacgacgtcgacctagttcgttccgtcgttgggtactacctaccatacaaacatacgtactattcgtacgtgggctagacctccgccgacgtcccggaagggtacgggtcgtggagtacggtattaggaatttacacttaagttacgaggacgggtacncctaacgttaactaagttaccctccggtaccctaagaagtcgttagacttaccaacttcgtaacgttcgtaaacgcaacgtaacaaccgtaacgtaaccgttacgttccgtaccggtagacggttaccncggtaacccgtccggttaggtacccgaccggtaccgacgtaacgaacccgtcggttaccgtgttaaccgttacgttcggtcgacggtaacccncgttaacgaccgtatacggttcncgtttaagggcgttacgggttagtaccgggg

SEQ ID NO: 177438 - DNA, 643 bp, Homo sapiens
  misc_feature: GYAE6OF02FR1ZS.48.9.A09.1.454.CMB.1.raw
  modified_base (167)..(167): a, c, t, g, unknown or other
  misc_feature (167)..(167): n is a, c, g, or t
  modified_base (339)..(339): a, c, t, g, unknown or other
  misc_feature (339)..(339): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagntgggtcctgtcccaggtgcagctgcagggagtcgggcccaggactgggtgaacgccgttcggacgacccctcggtccctcacgtcgcactgtctcgtggtcgacctccatcaacaatagtcacttactacgtgggctggactccgccacgtccccgagggacgggctggagnggtagttaggaattatcttatagtaggcggagcctaactatataactcccgtcctacgaacgtgtacgtacgtaccaaccattaacgtccgtagaccactaacgtacccgaaactaaccgtacgttccctacccgtgacgggtccaggtacccgcccgtaggcccgtaacccgccgtaccgacgggtaaccgacggtccttagttacccttagttaccgttcggtccgtaacccgtaccccgtaaggttcctaacgttacgtacgtaacgtttccggtacggtttgggttaacgttaccggggg

SEQ ID NO: 177439 - DNA, 621 bp, Homo sapiens
  misc_feature: GYAE6OF02HABUQ.48.9.A09.1.454.CMB.1.raw
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactgggtgaagtccgtttgggacgaccccgtgtcccctcacgttgcctactgtctcgtggtcgacctccatacaacaatagtcattactacgtcggggctggactccggccacgtccccggaaggggacggggctgggaggtggacttagggtaacttatctattagtaggacgggtacgcacctactataacgtcccgtcctacaagtacgtacgagtaccacctatacgtacccgtaagaccacactaccaacgtaacctacgtttcctccgtgacggtctgaccgtcccgtggtacgacccgccgtacgacgaccgacggtcctcgttaccttacgttcgtggtcgaccgaacccagtacccgtattactacgtagttacggtaccggtttaggttacggttaaccgggg

SEQ ID NO: 177440 - DNA, 746 bp, Homo sapiens
  misc_feature: GYAE6OF02H6J6Q.48.9.A09.1.454.CMB.1.raw
  modified_base (673)..(673): a, c, t, g, unknown or other
  misc_feature (673)..(673): n is a, c, g, or t
  modified_base (680)..(680): a, c, t, g, unknown or other
  misc_feature (680)..(680): n is a, c, g, or t
  modified_base (692)..(692): a, c, t, g, unknown or other
  misc_feature (692)..(692): n is a, c, g, or t
  modified_base (717)..(717): a, c, t, g, unknown or other
  misc_feature (717)..(717): n is a, c, g, or t
tcagagtatacatacacgaccggtgctcgatttagcgagacgcgcaggggcagggtgtacacctgtggttctcgggctgccctttggctttctgagagtcatggatcacatgtgcaagaaaatgaagcacctgtggttcttcctcctgctggtggcggcctcccagatgggtcctgtcccaggtcgcagctcgcgaggacggtccgggcccaggacgttggaggaacggtcccgtttacgggacgtaccccgttcgtccccctcgaccgtgacctaccgttgttccgttccgttcgggtactacctacctaactaccgtaaactaagttaacgtccttaaactttacgtaacggttcggggtcttcggaccgttcccgaccgtaccgtaccccggaaggggaacgggtcgtacgggtacggttggtaagttacggtaactttacgtaacttacgttaacgtacgggtaccgggacgtaccctaacccgttaaacgttaacgttaaccgttcccgttaacccgtacgtaaacggttcggtaccgacgttaccccgtaacgttactaaccgtaccgtagtaacctaaacctacgtaaccgaaacgaacccggttacgttcctaccgtacggcgtcgtacgccgtacccgtcgtacgacccgtcgacgacgtaacncggttcncgttataccgtntcggtcacccgtacagtccattacnctacgtacggtcgttggttacggtaccgg

SEQ ID NO: 177441 - DNA, 662 bp, Homo sapiens
  misc_feature: GYAE6OF02G3Y97.48.9.A09.1.454.CMB.1.raw
  modified_base (503)..(503): a, c, t, g, unknown or other
  misc_feature (503)..(503): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctctgctggtggcgctccagatgggtcctgtcccaggtgcagctgcaggcgtccgggcccaggcgtggtgacgtccttcggacgtacccttcgtccctcgacggtcgcctacttgtcctcgtggtcgacctcctaactacaaactatacgtctacttacgtacgtggggtctcggtactcccgaccgtacggtccccggtaagggggacggggtcgtaggggtacggtaggtaggtttaggtaactttagttacttaacgttagaggtaccgggtaactaccgtaaccttaacgttactaaccgttcccgtcctaacgtaagtcgtacggtctaaccgtacctaaagttacgtaccgtanaaccgtacctaacgtaccaaaacgtaccctacgtttccctaccgtggacgtcacgaccgtccgtacgtccggacctccgacagccgactcgtcttacgtacgttacgtcggcctacgtacctagtactagtcacgtgtagtacgtttgggtacgtacgg

SEQ ID NO: 177442 - DNA, 910 bp, Homo sapiens
  misc_feature: GYAE6OF02IL8C0.48.9.A09.1.454.CMB.1.raw
  modified_base (182)..(182): a, c, t, g, unknown or other
  misc_feature (182)..(182): n is a, c, g, or t
  modified_base (716)..(716): a, c, t, g, unknown or other
  misc_feature (716)..(716): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcacctgtggttcttcctcctgctggtgcggctcccagatggtcctgtccaggtncagctgcgaggagtcggcccaggactggtgaacgtccgtttcggacgaccccttcgtccccgtacaccggttcgacaccgttgtccttacgttggttcgacctcccgaacttccaaaacctaagttacggttacctaacttttaaccgttaaccggttggggggtaccttggggtaaccttccccggacccgtaaccgggttacccccccggaagggggtaaacgggggtccgttacgggtaacgggttagggtaacgtttagggttaaactttacgttacgtttaaagtttacgtaacgggtaccggggtaacgtaccgtaacccgtttaaacgttaaacgttaaccgttaccccgtaccccgttaacgtaaacgggtaccgttaccggtaagttaccccgtaaacccgtaacgtttaacctacccgggttaaacgaaaccctaacccgtaacgttaacccccgaaaacgtaaccccttaaacggttttaccccgtaccccgttagggaaccggttcccgtaacggttacccnccccggtttaggtacccggtaccccgacccggtacgtaaaccgggaccggtaacccggtaccgtttccgttacgtttaacgtttaccgtacggttacccggtacccgtaaccccgttagttaaccggaaacgtttacgtaccgttaaccggttacggtaaccgttttacggggggtttagtttaacccgggggg

SEQ ID NO: 177443 - DNA, 569 bp, Homo sapiens
  misc_feature: GYAE6OF02I9928.48.9.A09.1.454.CMB.1.raw
  modified_base (203)..(203): a, c, t, g, unknown or other
  misc_feature (203)..(203): n is a, c, g, or t
tcagagtatacatacacgaccggtgctcgatttagcgagacgcgcagggtgcctggagactgcgtcaacacaatttccccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccaggctcccaggctcctcatctctgctgcactcctacgacgggcctacgtggccactccccagacctaggttcagtggacaggtgggtctagggactagtacttcactctctcactcagcagacgtggagcgtagaagtatttgactaatttatactgtcactagtagtaggtactcgtctaccttaccgttaacgtttcggacgggacgggtaccgtagggtcggacggtaacgttaccgaaaacggtaacgttggtacggtactacggacgtaccctattaccgtgttacc

SEQ ID NO: 177444 - DNA, 573 bp, Homo sapiens
  misc_feature: GYAE6OF02JWAA6.48.9.A09.1.454.CMB.1.raw
  modified_base (238)..(238): a, c, t, g, unknown or other
  misc_feature (238)..(238): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (549)..(558): a, c, t, g, unknown or other
  misc_feature (549)..(558): n is a, c, g, or t
  modified_base (560)..(573): a, c, t, g, unknown or other
  misc_feature (560)..(573): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggagcccactcgccgaggtcgcacggtcggggcagtcgtggggctggaagtgaagagccgtggggcctcgagtgaaggtcncgtgcaacggcctcgttggtacgaccttcaccgccgtactccagctcgtcggccttcccgaccgaacgggccccagtccggtccttacccccgtcgggcccgcccgttacgccgtaccgacggtacgcccgtaccctcggtcgggggaccaccggtcgtccgggccccgtagggccgtcggtaccgtacgggtaccgaaaaccggggtcctttaccgttaccttacgttacggttaactccgttctacggcgggccggtcgttcgggacaacgggccgattacgaacggtncgngancngngnncncgngnnnnnnnnnngnnnnnnnnnnnnnn

SEQ ID NO: 177445 - DNA, 905 bp, Homo sapiens
  misc_feature: GYAE6OF02HHJ7B.48.9.A09.1.454.CMB.1.raw
  modified_base (149)..(149): a, c, t, g, unknown or other
  misc_feature (149)..(149): n is a, c, g, or t
  modified_base (796)..(796): a, c, t, g, unknown or other
  misc_feature (796)..(796): n is a, c, g, or t
tcagagtatacatacacgaccggtgctcgatttagcgagacgcgcaggggcacgaccggtgctcgatttagctgcgtcacgatctctcgttggggggggtctacgaggaggcagcactcgtcggacgtctccacatggcctggctcgtncctcctcctcacgtcctcctcacgtcgacgggacacgaggtactccgtacggtcctcgagtcctaccggtccctagacctccgtaccgtcccgttccgaccgttacgtacgggttccgggttacccggtcctaccggtagggaaccgtacggttacccggttacccaaccgtacgttacccggtacccgttacggtacccgtaacggttaccgggaaaacctccgggtaccgttaaaccggtagtttaaaccggtttaggttaccgggttaccgttaaacctttttaaccggttaaccgttttccgttaccccgtttacggttaaccggtaaacccttaacgacctttaacccggaacccggtaaccgtaaacccggtaaaacccggttaaccccggtaaacggtttaaccttaacgtttttacgttaacgtcggtaacgtttacgttaaccgtaaaccggtaaccggggtcccgtaaccccggggtttcgggtacctcggttaacccgtccgtttcttaccgtacggtcgtacccggttaacgttacgtaccgtcgtaacccgacgtacccggtcctaccgttacaccgttcctggtcggttacgcttaccgtaggacttacaacggttacttcggacttacgttntaacgttcggtttacaccgtttcgtttcgttacttttaccgttaacgttttacgttttaccgtttacgttaaccggttacggaccgggtttaccggtacggttaacccg

SEQ ID NO: 177446 - DNA, 569 bp, Homo sapiens
  misc_feature: GYAE6OF02IZD1M.48.9.A09.1.454.CMB.1.raw
  modified_base (191)..(191): a, c, t, g, unknown or other
  misc_feature (191)..(191): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
  modified_base (501)..(501): a, c, t, g, unknown or other
  misc_feature (501)..(501): n is a, c, g, or t
  modified_base (523)..(523): a, c, t, g, unknown or other
  misc_feature (523)..(523): n is a, c, g, or t
  modified_base (534)..(534): a, c, t, g, unknown or other
  misc_feature (534)..(534): n is a, c, g, or t
  modified_base (541)..(542): a, c, t, g, unknown or other
  misc_feature (541)..(542): n is a, c, g, or t
  modified_base (544)..(560): a, c, t, g, unknown or other
  misc_feature (544)..(560): n is a, c, g, or t
  modified_base (562)..(566): a, c, t, g, unknown or other
  misc_feature (562)..(566): n is a, c, g, or t
  modified_base (568)..(569): a, c, t, g, unknown or other
  misc_feature (568)..(569): n is a, c, g, or t
tcagagtatacatacacgaccggtgctcgatttagcgagacgcgcgagggggagcatcacccagcaaccacatctgtccctctagagaatcccctgagagctccgttcctcaccatggactggacctggagatcctcttcttggtggcagcagccgcagagcccatgccaggtgcacggtggggcagtcgnggggactggacgtgaagacggcctggggcctgaagtggagtctcctgcaaggcctgttaggtacaccgttccacgccgtactccagccgtcgtgggtccttccaaccgaacggggcccctaggtccggttaccccttccccggtcggtcccggtcccctacggcccttccggacggtaacgcctaccgtccggtagggggcctaaccgnggccccgggtccgttcgggnttacccggcggttaggtccggtaaacggtacccttacgttaccgtaaggtcttaacgtctacggtacggtacgggcggtcnggacgttaggcccggataacgngtgactgactnaagttcnngnnnnnnnnnnnnnnnnncnnnnncnn

SEQ ID NO: 177447 - DNA, 997 bp, Homo sapiens
  misc_feature: GYAE6OF02H9KQ4.48.9.A09.1.454.CMB.1.raw
  modified_base (972)..(972): a, c, t, g, unknown or other
  misc_feature (972)..(972): n is a, c, g, or t
tcagagtatacatacacgaccggtgctcgatttagcgagacgcgcaggggcagggtgtacacctgtggttctcggggctgcctttggctttcgtgagagtcatggatcacatgtgacaagaaatgaagcacctgtggttcttcctcctgctggtggccggctcccagattcgggtcctgtcccaggtgctagctgcgaggacgtccgggccagggacctggtacgaacgtccgtttccgggacgtaaccccttcgtccccgttacgacggtacgtaccgtacgttcgtcgttacgttacgggtacgtaccgtaccgtaatacccaaaacgttaagttaacgtacttaaacgtttaaccgttacgggtccgggggtaaccgttacgggtacccgttaccccggacccgttaaccggtaacccccgggtaaggggggtaaccggggttaccgtagggggtaacggttaccgggttaaagtttaacggggtaaaactttttaacgtaacggtttaaacggttttaacggtacggggtaaccggtaaaccgtttaacccgttaaaacccgttaaactttaccggttaaaccctttaccccggggttaacccctaaagggtaaaccggttacgggttaaaccgtaaccgggttaaccctaaccccgttaaaagttaccccggttaaaccccggtaaacgaaaccgtaaacccggttaacccctaaaccggtaaaaaccggttaaacccccggtttacggttttacccccgttacccgggtaaacggggttacccgaccgtttaaacgggaccccggttttacccggtaacccgggttcccgaaacccggggttccccgacggttaaaccgaccggttaacccggtcgtttaaacccggtacttttaacgtacccggttacggtcggtaaacccccgtactaacgttttaaccgattaccgttaagacccgtttaggnggtttttacccgggtggtaacccgg

SEQ ID NO: 177448 - DNA, 563 bp, Homo sapiens
  misc_feature: GYAE6OF02J14G1.48.9.A09.1.454.CMB.1.raw
  modified_base (57)..(57): a, c, t, g, unknown or other
  misc_feature (57)..(57): n is a, c, g, or t
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagagtatacatacacgaccggtgctcgatttagcgagacgcgcaggggcagggtntacacctgtggttctcgggctgccctttggctttctgagagtcatggatcacatgtgcaagaaatgaagcactgtgtctcctctgctggtgcgctccagatgggtcctgtcccaggtcncagtctgcagggacgtccggccaggctgganacgcttggacncctgccctgacgtncattgtcacgtggtcgaccnccgatcaaactagtacgtcctaagtttaccagtcgggtctacggtntccgactacggtacccggagggacggtgtaggacggtgaaggtttcgaacttttgacgttatgtacggcggtanccgtactagtactacgtccgactanacgttcgngacgtcacgtatacgtacacgtacacgntacacgactacgtctacngagcgtagctaccgtgtccgaccgtcncgacncgtacgngttacgtntacgttcgtacgtcgacccgtactacgtactagtacgctacgttgaacccggttgttacggtacg

SEQ ID NO: 177449 - DNA, 666 bp, Homo sapiens
  misc_feature: GYAE6OF02GW3EA.48.9.A09.1.454.CMB.1.raw
  modified_base (637)..(637): a, c, t, g, unknown or other
  misc_feature (637)..(637): n is a, c, g, or t
tcagagtatacatacacgaccggtgctcgatttagcgagacgcgcaggggcagggtgtacacctgtggttctcggggctgccctttggctttctgagagtcatggatcacatgtgcaagaaaatgaagcactgtgttcttcctcctgctggtggcgctcccagatggtcctgtcccgaggtgcagctgcaggacgtccggccaggacgtggtagaacgccgttacggacgaccctcgtccctcgacgtgcactgtctcgtggtgactccgatacaactaatagtactaattacgtacgtaggggtctaggaactcccgacctacgtaccccgaagggacggtctacggagtggattacggaatttagtacttagtaagtaggcggaacgtactaaccgttacgtaacgtaacgtcccgtacctacgaagtacggtacgacgtaccaaactactaacgtaccggtaacaccgaactaacgtacccaaaacgtaacccgttacgtttaccccgttacccgtgggaacgtaccgtaggacccgtacccgtagtacccggaacccgtcggaaccgtaacgaacgaccggtctacgttactacgtttagtcggtacgaaccgtaccctatacgtaatacgtntactccggttaagttcggtacgttacggg

SEQ ID NO: 177450 - DNA, 594 bp, Homo sapiens
  misc_feature: GYAE6OF02GOE87.48.9.A09.1.454.CMB.1.raw
  modified_base (535)..(535): a, c, t, g, unknown or other
  misc_feature (535)..(535): n is a, c, g, or t
  modified_base (538)..(539): a, c, t, g, unknown or other
  misc_feature (538)..(539): n is a, c, g, or t
  modified_base (541)..(542): a, c, t, g, unknown or other
  misc_feature (541)..(542): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
  modified_base (579)..(580): a, c, t, g, unknown or other
  misc_feature (579)..(580): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
tcagagtatacatacacgaccggtgctcgatttagcgagacgcgcagggggagcatcacccagcaaccacatctgtcctctagagaatcccctgagagctccgttcctcaccatggactggacctggaggatcctcttcttggtggcagcagccgcaggacgcccactgccaggtgcacgtggggcagtcgtgggctgaagtgaagaggccgtggggcctcagtgaaggtcctctgacaaggcctcgtggttagaccttcgaccgtccgctaaaaaaaccgcgaccttctacggtccttaccgaccgaaacggggcccaacgttccggtacccttcccccgtacggtccgccccttgtccgtaccaggacgtcccaccgtcggtcgggggaccacgacggccggtccgtcgggtaccgtcggtcctgggtaaccaaagggtaccctttaacgtttcctaattcgttaacttccgtagggaacgggtcggtacggtacggaccgtaagggacgaccgtacgttaaggcgatacggnacnncnncacgacgtagtcacgncangncgancgtgcancgatnntacngncntganac

SEQ ID NO: 177451 - DNA, 672 bp, Homo sapiens
  misc_feature: GYAE6OF02IUQEE.48.9.A09.1.454.CMB.1.raw
tcagagtatacatacacgaccggtgctcgatttagcgagacgcgcagggcaggtgtacacctgtggttctcggggctgccctttggctttcgtgagagtcatggatcacatgtgacaagaaatgaagcactgtggttcttcctctgctggtggcgctccagatggtcctgtccgaggtgcagctggcaggacggtccgggacccgaggacgtggcgaacgtccgttcgggaccacccgttccgtccctacaccgtcgctacgtgttctcgttcggtcgactaccgtataaccaactaagtcggtacttataacgttcggtgggtctacggactcccgaccgtaccgtacccggaagggggacggcgtagggtcgtaggtagttaggtaattatacgttaacgttagtagggtaccggtacgtacctaaccgttaacgtaacttacccgttccctacgtaaccgtaagtacgtaccgtacgtaccacgttaactaccgtaccgtacgaacctaacgtactaaccgaaactacctaacgttcccgtccgtacgcgtactcgaaccgtccgacgtaccggcccgaccgacgtcgacggtcgtacgtcgttaactagttcgtcgtcggacctacgtctacgtactcacttacgtacgttaggttggtacggttcgg

SEQ ID NO: 177452 - DNA, 175 bp, Homo sapiens
  misc_feature: GYAE6OF01C2UUE.8.25.C03.1.454.CMB.1.raw
  modified_base (175)..(175): a, c, t, g, unknown or other
  misc_feature (175)..(175): n is a, c, g, or t
tcagctcgcgtgtccacgaccggtgctcgatttagtagtgtagatttgggtttgggggaagaggaagactgacggtcctgctccaggagcacctccgagagcacagcggccctgggctgcctggtcaaggactacttccgacacgcgagctgagcgggctggcaaggcgcatagn

SEQ ID NO: 177453 - DNA, 547 bp, Homo sapiens
  misc_feature: GYAE6OF01AD27P.8.25.C03.1.454.CMB.1.raw
  modified_base (536)..(536): a, c, t, g, unknown or other
  misc_feature (536)..(536): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggagcttggtacagccagggcggtccctgagactctcctgtacagggactggattcatctttggtgactatgctgtgacctgggtccgccaggctccagggagggctggagtgggtagtctcattagagtaaagcttatggtgggacaacagattacgccgcgtctgtgaaggcagattcacatctacaagagatgattcaaagcatcgcctttctacaatgacagcctagaaaccgagacacaggctgtatactgacaactaggtttaggtacggaatccgacaaagtgaccgtcgtagggaccgagggaacccgtggtaccgaccgtctacctcngtccctacccg

SEQ ID NO: 177454 - DNA, 582 bp, Homo sapiens
  misc_feature: GYAE6OF01C0HUW.8.25.C03.1.454.CMB.1.raw
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactcgtggggggagcttggtacagccaggggcggtccctgagactctcctgtacagggactggattcattctttggngacttatgcttgtgacctgggtccnccaggctccgagggaaggggctgggagtggggtaatctcagttagaagtaaagcttatggtggacaacagattacgccgcgtctgtagaaaggcaagattcaccatcacaagagatgataccaaaagcatcgcctttacaacaaatggacagacctagaaaaccgaggaacacgaggcgtagtattacgtgacacgtaggtttggtacgggaaatccgaacaaaatgaccgtcgtaggggaccgacgggaaccctggtacctacccgtcctccctacgcgcccgtacccg

SEQ ID NO: 177455 - DNA, 600 bp, Homo sapiens
  misc_feature: GYAE6OF01EJ71T.8.25.C03.1.454.CMB.1.raw
  modified_base (294)..(294): a, c, t, g, unknown or other
  misc_feature (294)..(294): n is a, c, g, or t
  modified_base (421)..(421): a, c, t, g, unknown or other
  misc_feature (421)..(421): n is a, c, g, or t
  modified_base (538)..(538): a, c, t, g, unknown or other
  misc_feature (538)..(538): n is a, c, g, or t
  modified_base (589)..(589): a, c, t, g, unknown or other
  misc_feature (589)..(589): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggtttttccttgttgctattttaaaaggtgtccagtgtgaggtgcagctggtggactcgtggggggaggcttgggtacagccaggggcggtccctgagactctcctgtacagggactggattcattctttggtgactatgctgtgacctggggtccnccaggctccgaggggaaggggctgggagtgggtaagtctcagttaagaagtaaagcttaagtgggtagggaacaaacgagtacttacggccgcgtctggtagaaaggcagattcacatctacaaagngatgaattaccaaaagcatccgtacctttactaacaaatggaacacgacctacgaaaaccgaggaacaacgaggcgtgtattactgactaacgtagggtttaggtacggaatccganaaagtcgaccgtcgtgggaccgacgggaaccctggtaccaccgtctcctcncgtccctaccg

SEQ ID NO: 177456 - DNA, 176 bp, Homo sapiens
  misc_feature: GYAE6OF01DIVS5.8.25.C03.1.454.CMB.1.raw
  modified_base (175)..(176): a, c, t, g, unknown or other
  misc_feature (175)..(176): n is a, c, g, or t
tcagctcgcgtgtccacgaccggtgctcgatttagtagtgtagatttgggtttgggggaagaggaagactgacggtcctgctccaggagcacctccgagagcacagcggccctgggctgcctggtcaaggactacttccgacacgcgagctgagcgggctggcaaggcgcatagnn

SEQ ID NO: 177457 - DNA, 574 bp, Homo sapiens
  misc_feature: GYAE6OF01B2U1Q.8.25.C03.1.454.CMB.1.raw
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattaccaaaagcatcgcctttctacaaatggacagcctagaaaaccgaggacacaggcgtgtatactgacaactaggtttggttacgggaaatccggaacaaaatcgacctcgtcggggccaagggaaccctggtcaccgtctcctcacgcctaccaccgaacgggcccagtccggtccttaccccgtggccgccctgcctccgacggacgcccgacctcgagacgccaacgacggccggcccgtagggcctggcccgtacggg

SEQ ID NO: 177458 - DNA, 581 bp, Homo sapiens
  misc_feature: GYAE6OF01EH4AE.8.25.C03.1.454.CMB.1.raw
  modified_base (384)..(384): a, c, t, g, unknown or other
  misc_feature (384)..(384): n is a, c, g, or t
  modified_base (529)..(529): a, c, t, g, unknown or other
  misc_feature (529)..(529): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccgaggggaaggggctggagtgggtaagtctcattagaagtaaagcttatggtgggacaacagattacgccgcgtctgtgaaaggcagattcaccatctacaagagatgattaccaaaagcatcgcctttacaacaaatggacagacctagaaaaccgaggacacgaggcgtgtattacngacaacgtagggtttggtacgggaatccgacaaagtcgacctgtcgggaccaacgggaccctggtccaccgtctcctcacgccctccaacgacgggcccacgtccggttcccttccccgtggccgtccctcgcctaccgaggacnccgacccgtcgagcgccgacgacggccggacccgtgggctcggccgtacggg

SEQ ID NO: 177459 - DNA, 374 bp, Homo sapiens
  misc_feature: GYAE6OF01EOAKG.8.25.C03.1.454.CMB.1.raw
  modified_base (360)..(360): a, c, t, g, unknown or other
  misc_feature (360)..(360): n is a, c, g, or t
  modified_base (366)..(374): a, c, t, g, unknown or other
  misc_feature (366)..(374): n is a, c, g, or t
tcagctcgcgtgtccacgaccggtgctcgatttagtagtgtagatttgggtttggggcagggagtgggctaaggtgaggcaggtggcgccagccaggtgcacacccaatgcccgtgagcccagacactggaccctgcctggaccctcgtggatagacaagaaccgaggggcctctgcgccctgggcccagctctgtcccacaccgcggtcacatggcaccacctctcttgcagcctccaccaaggcccatcggtcttcccctggcgccctgctccaggagcacctccgagagcacagcggccctgggctgcctggtcaaggactacttccgacacgcgagctgagcgggctggcaaggcncatagnnnnnnnnn

SEQ ID NO: 177460 - DNA, 591 bp, Homo sapiens
  misc_feature: GYAE6OF01BT20H.8.25.C03.1.454.CMB.1.raw
  modified_base (487)..(487): a, c, t, g, unknown or other
  misc_feature (487)..(487): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
tcagctcgcgtgtccacgaccggtgctcgatttagtagtgtagatttgggtttgggggggagggcttggtacagccagggcggtccctgagactctcctgtacagggactggattcatctttggtgactatgctgtgacctgggtccgccaggctccagggaaggggctggagtgggtaagtctcattagaagtaaagcttatgggtgggacaacagacttacgccgcgtctgtgaaaggcagattcaccatctcaagagatgattaccaaaagcatcgcctttcacaaatggacagcctagaaaaccgaggacacaggcgtgtattactgcaactagggtttggttacgggaaatccgacaaaatgacctcgtggggccagggacctggtaccacgtctcctcacgcctaccacgaacgggcccagtccggtccttccccgtggccctcccgtacgcctccggaggacgtaccacccgttccgganacgccacgcggccggccgtgggcctcgacccgtggtccaacggtaccgtacgttccgacacggcgacgcgtaggcggtcgggcgtcggcgaaggccganagtgn

SEQ ID NO: 177461 - DNA, 809 bp, Homo sapiens
  misc_feature: GYAE6OF01AQ2QV.8.25.C03.1.454.CMB.1.raw
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctgggtggactcgtgggggagtcttggtacagccaggggccggtccctgagactctcctgtacgagggactggattcattcgtttggtgactatgctggtcgaccgtcgggtcccgcgaggtcctccggaaggggacggggctggggaggtggggtaactcctagtaagttaagaaagtaaggtcttaggtgggtacggaacaagagtacttaccgccgtacgtcgtaggtagaaaggctaagtacttaccgaacctagtacctaacgaaagtacgtaagtacgtaacttaaccgaaaaacgtccgtaacgttacccgttacccttttaaccgtaaacgtaaaaccggttacgggaaccctaaaccgggtaaccccgtaaaaccgggtaaaacccggaaccgggtaaaccgaaccggtaacgggttaaccgttagttaaccgttacgtaacggtaaccgttaacggttaaggggttttaccgggttaaacgtaaccggtaaccctaagtaaaccgtaccgtaacccggtcgggtaccggggacccggtaaccggggtaaccccgttacgggtacccgttaaccccggttcccgtaccctacccggtaacccgcccgtaaaccccgg

SEQ ID NO: 177462 - DNA, 631 bp, Homo sapiens
  misc_feature: GYAE6OF01CLAW9.8.25.C03.1.454.CMB.1.raw
  modified_base (175)..(175): a, c, t, g, unknown or other
  misc_feature (175)..(175): n is a, c, g, or t
  modified_base (341)..(341): a, c, t, g, unknown or other
  misc_feature (341)..(341): n is a, c, g, or t
  modified_base (385)..(385): a, c, t, g, unknown or other
  misc_feature (385)..(385): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtnactatgctgtgacctgggtccgccaggctccgaggggaaggggctgggagtgggtaagtctcattagaaagtaagcttagtgggtagggacaacagattacgccgcgtctgtagaaaggcagattcacatctacaagagatgattaccaaaagcactctaccttanacaagtgacagctagaaacgaggacaacgagtcgtagtattacngacaacgtagggtttggtacggaaactccgactaaagtcgacctcggtacgggaccgaacgggaaccctgggtacctacccgtctccctccgacgccctacccgaaccgacggaccctacgttacccggttcccttcccccgtcggcccgtccgtcgcctccgacggacgtcccgtacccgtaccggaaggccgtaccgaaccgacgggacccggtccccggagggtcccgtcgcccgggttacgg

SEQ ID NO: 177463 - DNA, 816 bp, Homo sapiens
  misc_feature: GYAE6OF01ELCN1.8.25.C03.1.454.CMB.1.raw
  modified_base (309)..(309): a, c, t, g, unknown or other
  misc_feature (309)..(309): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggtttttccttgttgcttattttaaaaggtgtccagtgtgaggtgcagctggtggactcgtggggggagcgttggtacaggccgaggggccggtccctgacgactctcctgtacgagggtactggattcattcgtttggtagacttagtgcgttgtcgaccgttggggcccnccgaggcctaccggaagggggaacggggtcgtaggggacggttaggggtaaacgttccgtaacgtaagttaaaggaaacggttaaaacgtcgttttaaggtcgggtaacgggaaaccaaacgtaaggtaaccttaccggacccggtcggttcgttagggtaacgggaaaaggcctaagtaacttaccaaccgtactaccgttacgaaaaggtagtaacgttacgttaaacttaacccgaaaaacgtccgtaaccgtttacccgttaaccccttttaacgtaaaaccgtaaacggttacgggaacccgtaacggtacccgtaaaacggaaaaaccccggagggtaaccaacggtacgggtaccgtaagttaacctttacgacgtaacctaacggttagggtttacggtaacggaactaccgaacgtaaacgtcgtacccgtgggaacgggacccgtaacgggtacccgtcggaccctacccgtctacccgacgccgtcccgtacccgg

SEQ ID NO: 177464 - DNA, 824 bp, Homo sapiens
  misc_feature: GYAE6OF01C67PD.8.25.C03.1.454.CMB.1.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctggttttctgtgctatttaaaggtgtccagtgtgaggtgcagctggtggactcgtggggggagcttggtacaggcccgaggggccggtccctggagtacctctcctgtacagggactggattcattcgtttgggngactatgctggtgaccgtgggtccncgaggctaccgaggggaacggggctaggggaggtagggtaagtctacagttaaggaagtaaagtcttaagngggtagggacaacgagtacttacggcgtcgttctaggtagaaacggtnaagtacttaccgaacctatcccgtagaaaggacgtagttacggtaacttaacccgaaaaaggtcctaagttcccgttacccctttttaccgtaaaacgtaaaagtttcgggaaaccctaaggtaaccccgttaaacggaaaaacccggtacgggaaacccaaccgggtaacgggtaccggtttaacgttaacgtttaacccgtaacgggtaaccctaaacgggtttacggggtttttacgggttaaccgggtaaaaccgtttccccggaaacgtaaaaaccgttccggtaaaccccgttacggggtaccgggggtaacccccggtaaaccgggggtaaccccgttaggggtacccccgtaccccgggtttaccaccccggtccgtaacccggtccccgtaaaccccccgg

SEQ ID NO: 177465 - DNA, 751 bp, Homo sapiens
  misc_feature: GYAE6OF01E2YD4.8.25.C03.1.454.CMB.1.raw
  modified_base (370)..(370): a, c, t, g, unknown or other
  misc_feature (370)..(370): n is a, c, g, or t
tcagctcgcgtgtccacgaccggtgctcgatttagtagtgtagatttgggtttggggagccgtgagattcccaggagtttccacttggtgatcagcactgaacacagaccaccaaaccatggagtttgggcttacctgggttttccttgttgctattttaaaaggtgtccagtgtgaggtgcagctggtggactcgtggggggaggcttggtacagccaggggcggtccctgagactctcctgtacagggactggattcattcttggtgacttatgctgtgacctgggtccgcaggctaccggaggggaggggctggaggtgggtaatctataattagaagtaaagtcttaagtgggtaggaactaacgnggtaacttacggccgtacgtctaggtagaaacggctaagacttccacctatctacaaagagatgtaactaccaaaagtcaatccgtactttactaacaaagtcggaacacgtacctaaggaaaacccgaggaacctaagtacgggtacgttacgttaacttacgtacgtaaccgtaaacggttaacggggtttttacggggttaacccggggtaaaaacttaccccggtaaacctaaaaaaccgttaccggtaaccccggtttccgggtaccggggggtaaccccggtaaaccgggggttaaacccccgttcggggttaccccgtaaccccggtttccccttaccccgttacccggaacccgtcccccgtaaaccccccgg

SEQ ID NO: 177466 - DNA, 746 bp, Homo sapiens
  misc_feature: GYAE6OF01BYM2M.8.25.C03.1.454.CMB.1.raw
  modified_base (339)..(339): a, c, t, g, unknown or other
  misc_feature (339)..(339): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattctttggtgactatgctgtgacctgggtccgccaggctccgaggggaagggctggagtgggtaagtctcattagaagtaaagcttagtgggtggaacaacagattacgccgcgtctgtagaaaggcagattcaccatctacaagagatgacttacaaaagcatcgtctttanaacaatggacagctagaaaacgaggacacgaggcgttagtaacttactcgaactaaacgttaggggttttacgggttaacgggtaaaacttcccggaaactaaaacgtcggtaaacccgttccggtacgggggacccgaacggggtaaaccccgttgggtaccctaacccggttcctacccgtaccgtaaccgccccttacccgaaccggaacccgggtacccctaaccggttccccgggtttccccgtttccccccgtgggtccccgtccccgttcggtacccttacccggaacgggaccgtaccccgtaaccccggtaccccggaacggacccggacccgaaccggaccgggtcccccggggtaccccggttacggggtcccttccgggtcccggttaaccgggg

SEQ ID NO: 177467 - DNA, 665 bp, Homo sapiens
  misc_feature: GYAE6OF01AQ97B.8.25.C03.1.454.CMB.1.raw
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactcgtggggggaggcttggtacagccaggggcggtccctgagactctcctgtacagggactggattcatctttggtgactatgctgtgaccgtgggtccgccaggctccgaggggaggggctggagtgggtaagtctcagttagaagtaaagcttaagtgggtagggacaacgagacttacgccgcgtctggtagaaaggcagtacttcaaccgtatcgtacgaagagtatgattaaccgaaaagctaactccgtacctttacaacaaagtcggaacacggacctaacggaaaaccgaggaaccacgacgggtacgtagttaacttacgtagaactaacgttagggtttagggtaacgggtaaactacccggaacgtaaaagtcggaacccgttcggtaccgggggacccaacggggtaaccccgttcgggtacccaccccggttctaccccgtcgaccgtcccctaaccccgg

SEQ ID NO: 177468 - DNA, 803 bp, Homo sapiens
  misc_feature: GYAE6OF01DA7QB.8.25.C03.1.454.CMB.1.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggtttccttgttgctattttaaaaggtgtccagtgtgaggtgcagctggtggactcgtggggggagcttggtacagccgaggggccggtccctgacgactctcctgtacagggactggattcattcgtttggnacttatgctgtcgaccgtgggtcccnccgaggcctaccggaagggggaaggggctaggggtaggttaggggtaacttctacgtaagttaaggaaaagttaaagtcgtttagtacggggtacgggaaacaacgtaggtacttaccggccgtcgtcgtaggtaacggaacggcaagtacttccaacctattactacgaaagtagtaattagtaacttaaccgaaaagtctaacgttacccgttacccttttaacaaacgtaaagtcgggaacctaacggtaacccctaaacgggaaaaccccggaaggaaccaacggtacgggtacggtttaacgttaacgtttacgtacgtacgtaaacggtttacggggttttacgggtaacgggtaaactacccggtaaactaaaacgttccggtaacccggtacgggtacccgggggaacccgtaaaccggggttaaccccgttacgggttaacccccgtacccggttacccgttacccgtaacccgtcccgtacccccgtaaaccccggg

SEQ ID NO: 177469 - DNA, 670 bp, Homo sapiens
  misc_feature: GYAE6OF01AUJJN.8.25.C03.1.454.CMB.1.raw
  modified_base (405)..(405): a, c, t, g, unknown or other
  misc_feature (405)..(405): n is a, c, g, or t
  modified_base (609)..(609): a, c, t, g, unknown or other
  misc_feature (609)..(609): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggatttcatctttggtgactatgctgtgaccgtggggtccgccagggctccgaaggggaaggggctggagtgggtaagtctcattagaagtaaagtcttagtgggtaggacaacagattacgccgcgtctgtagaaggcagattcacatctcaagagatagtactacaaaagctatccgtaccttttcaataaagtcggacagacctaagaaaaccgacgaacaacgacggacgttgtaattacgngtaacaacgtagggtttacggtaaggaaactccgaacaaaactcgtacctggtacgggaccgaacgggtaccgtcgggtaccaaccggtctacccgctacgccctacccgaaccgaaccggaccctagttacccggtcccgttaccccgtggtacccgtccctccggccaccggtacggacgtacccggtaccctaccgggaanaccgaccgtaaccggtaccggacccgggtcccggcgggtaccctcggtcccggttaacggg

SEQ ID NO: 177470 - DNA, 893 bp, Homo sapiens
  misc_feature: GYAE6OF01D054O.8.25.C03.1.454.CMB.1.raw
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgcttatttaaaaggtgtccagtgtgaggtgcagcgtggtgactcgtgggggagtcgttggtaccaggccgaggggccgtcccgtggacgacctctccgtgtaacgagggactggtacttcagtttcgtttggtacgtaactagtgtcgttggtacggtacccgtcggggtcccgccgtacgggtccgtaccgggaagggggtacggggtcgtaggggtaagggttacggggttaaacggttccgttaacgtaaggtttaaaagggtaaaacggttaaaacggttcgttttaagggtagggggtaaccgggtaaacctaaacgtaacggtaaccgtttaacccggccccggttacggttacggttaggtaaacgggaaacgggtcctaaaggttaccttaccgaaccctacgttacccgtaaacgtaaagggtaacgtagttaacggttaaacctaaacccgaaaaagtccctaacgtttacccggttaaccccttttaaaccgaaacgtaaagttacccggaaccgtaacccggtaaacccgtaaaacgggaaaacccgtaggaacccgtacgaacgggttacgttagttaacgttaccgtacgtaaccgttaaacggttcgggtttacgggtaacggtaacgtaccgtaaagaaacgtcgtaccggtacgggccgggtacggacccgggtaccgtcggtacccgtacccgtcctacccgtaccgcccgtcccgtaaccccgg

SEQ ID NO: 177471 - DNA, 1131 bp, Homo sapiens
  misc_feature: GYAE6OF01ECWML.8.25.C03.1.454.CMB.1.raw
  modified_base (175)..(175): a, c, t, g, unknown or other
  misc_feature (175)..(175): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattctttggnacttatgtctggtcgaccgttcgggtcccgccgaggtcctaccggaaggggaaggggtcgtgggtaggttaggggttaatctacgtaagttaagaaagttaaagtcgtttaaggtgggtaggaacaacgtagtaacgttaccgccgtcggttacgttaggtaaggaaacggctaaggtacttccgaacctagttcacgaaaggtagtaagtacgtaaaccttaaccgaaaagtccgtaacgttttccccggtttaaccctttttaaactaaaaccgttaaaaacgggtacgggtaaaacccgtaacggtaaaccccggtaaaacgggaaaaaaacccgggaacgggtaaacccgtaaaccgggtaacggggttaccggtttaacggtttaaacgtttaaaccggtaacggtaaacccggtttaaaacgggttttaacgggggttttttaaaccggggttaaaccggggtaaaaccgttaacccgggttaaaacgtaaaaacgtttccgggtaaaccccggtttacggggtaaccggggggtaaccccgtaaaaccgggggttaacccccggttacgggttaccccgttaaccccgggttcccgtttaacccccggtacggtaaaccccgtttaccccccggtaaaccccgtaaacccccggggtaacccgggtttaaccccgttaccccggggtttaccccccgggttttaccccccgttaccccccgggtttacccgggtaccccccggttaccccccgttaccgggtacccccggtttaacccggggaaacccgggtttaccccggaacccccgttaaacccccggtaaccggggtaaacccggaccggtaaacccccggttaacggggaaaccccccggggttcccccggggttaacccgggttcccgggggtacccgtttaccccgggtaccccggggtttaaaacccgggg

SEQ ID NO: 177472 - DNA, 663 bp, Homo sapiens
  misc_feature: GYAE6OF01APZK6.8.25.C03.1.454.CMB.1.raw
  modified_base (405)..(405): a, c, t, g, unknown or other
  misc_feature (405)..(405): n is a, c, g, or t
  modified_base (509)..(509): a, c, t, g, unknown or other
  misc_feature (509)..(509): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattctttggtgactatgctgtgacctgggtcccgccaggctccgaggggaaggggctgggagtgggtaagtctcaattagaagtaaagctttagtgggtagggacaacgagattacgccgtcgtctgtagaaaggcagtattcaccatctacaagagatgaacttaccaaaagcatccgtcctttacaacaagtggaacagccctaagaaaaccgaggaccacgaggcgtgtacttacgngactaacggtggtttcggttacgggtaaactccgaacaaagtccgaccgtcgtcggggaccaacgggtaccctcggtaccgaccgtcctacctcgaccgtcccncccgaaccgaccgggtaccccacggttccccgggttccctttccccccggtcggtcccgcccccgtcgtcccgtacccgagggaccgtcccgacccgtaccggacgccgaccgacgaccggtcccggacccgtagggtcctccgggcgtacggg

SEQ ID NO: 177473 - DNA, 656 bp, Homo sapiens
  misc_feature: GYAE6OF01AY9VX.8.25.C03.1.454.CMB.1.raw
  modified_base (405)..(405): a, c, t, g, unknown or other
  misc_feature (405)..(405): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattctttggtgactatgctgtgaccgtgggtccgcaggcctaccgaggggaaggggctggaggtagggtaagtctcattagaagtaaagcttagtgggtaggaacaaacgagattaccgccgcgtctgtagaaggcagattcacatctacgaagagatagacttaccaaaagcaagtcgtcctttacgaacaaagtcggaacagaccgtaagaaaccgagaacacaggcgtagtattacngactaagtagggtttaggttacgggaataccggaacaaacgtcgaccgtacgtacgggaccgaacgggaacctcggtacctacccgtctccgactaccgcccgtacccaaccggtaaccggacccctacgtacccgggttaccccttcccccgtggccccgtcccgtacgcccgtaccgacgggacacccgtacccggtaccgaggacgcccgagacggcccggtaccgtcgggccgtcggccgtaacggg

SEQ ID NO: 177474 - DNA, 845 bp, Homo sapiens
  misc_feature: GYAE6OF01BQKEG.8.25.C03.1.454.CMB.1.raw
  modified_base (194)..(194): a, c, t, g, unknown or other
  misc_feature (194)..(194): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttcctgttgctattttaaaaggtgtccagtgtgaggtgcagctggtgactcgngggggagcttggtacagccgagggccggtcctaggacgtacctctcctagtaccgagggtactggtacttcagttcgtttgggtagtaccttagtcgcgttaggtcggtacccggttcggggtccccgacgtacgggtcctaccgggaagggggaacgggggtctaggggtacggtaggggtaacgtcctacgtaaagtttaaggaaacgtaaacgtgtttaaggtgggtaacgggaacaacgtggtaacgttccggaccgtcgtacgtacggtaaggaaacgctaaggtacttaaccgaactagtcctaaacgaagacgttacgtaggtaaccttaaccgaaaagtcctaacggttaccctttacctttaaccgtaaacgtaaacgtaccgggaactaacggtacccgtaaacggaaaaccccggtaaggaaccgtaacggtaacgggttacggttaacttaacgtttacccgtacggtaaccgtttaaacgggttcgggttttacgggtaaaccgggtaacttaccccgggaaataaaaccggttcggacccgtttccggggaccggggtaaacccgtaccgggggttacccctacgggttaccccaaccgttccgtaccccggactcccggaccccttaaaccccggg

SEQ ID NO: 177475 - DNA, 716 bp, Homo sapiens
  misc_feature: GYAE6OF01A9X1T.8.25.C03.1.454.CMB.1.raw
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (374)..(374): a, c, t, g, unknown or other
  misc_feature (374)..(374): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtcgaccgtggtccgcaggctaccgagggagggctggagtgggtaatcgtnattaagaagtaagtcttagnggtaggacaangatcgccgcgtcngtagaagcagattcacatctacaagagatagacttaacgaaagcctaactccgtcctttacgtaataaatcggacacgacctaacggaaaaaccgngaacacgacggtcgttagtaattacgtcgacgtaaacggttagggtttacgggttaccggtaaacgtaccgaaagtaaacgaccgtaccgttacggtacggggacccgtaaacgggaacccgttacgggtaccgtacccgtaccctccgtacgacgtacccctaaccgacccgacggtacccgtaccggttcccgttacccgttcccccggtggtccccgtcccgtaccgcccggttaccgaccggggtacccaacccggtacccgacccgggaacgtccgaacccgacgacccgggtcccggaccgggtaccggtccgtccgggtccccgttaaaccgggg

SEQ ID NO: 177476 - DNA, 680 bp, Homo sapiens
  misc_feature: GYAE6OF01BQKIC.8.25.C03.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattctttggtgactatgctgtgacctgggtccnccaggctcgagggagggctggagtggtaagtctnattaagaagtaaagcttagtggtaggacaacagtacttacgccgcgtctgtagaaagcagtattcacatctacaagagtatagacttaccaaaagctaatcgtacctttactaacaaatcgaacacgacctaacgaaaaccgaggaacacgaggacgttagtacttagacgactaacggtagggttttacgggtaacgggtaaacgtccgaactaaaacgtcgtaacccgttcggtaacggggaccgtaacgggaaccccgttgggtcccaaccgttccgttccctacgaccgtccctaccgaacccgaacgggccctacggttcccggttccgttccccgtcgcccgtcccgtgccccgtacgacggaccgtacccgaccgtaccggacggaccgccaacccggtacggcccgggtacccgtggggcccttccggccgttaaccggg

SEQ ID NO: 177477 - DNA, 796 bp, Homo sapiens
  misc_feature: GYAE6OF01A8MWT.8.25.C03.1.454.CMB.1.raw
tcagctcgcgtgtccacgaccggtgctcgatttagtagtgtagattttgggtttgggtgccgaagttgctggaggtcacggtcaccacgctgctgagggagtagagtcctggaggcttggtacagccagggcggtccctgagactctcctgtacgagggactggattcattcgtttggtgactatgctgtcgaccgtgggtccgccgaggcctccggaaggggaacgggggctagggaggttaggggtaaacgttctactaagttaaaggaaagttaaagtctttaggtggggtacgggaacaaacgagtaacgttaccggcccggtcgttcgtggtaaggaaaacggctaaaggtactttaccaaaccctattacctaacgtaaaaggaacggtaagttaggtaactttaaaccgaaaaaggtcctaacgtaccggttacccttttaacgtaaaacgtaaaacggtacggactaaaccggtaccgtaaacggaaaaaccgggacggaaacacgaacgggtcgtaagttacttacgacgaacgtaagttagggtttacggtaacggtaacgtacgaactaagtacgtacgtacggtacggacgacggtaccgtacgtacgtacgtccgtccgtacaccgtccctacccgaccgaccggaccgtaccgtaccgttccccgttacccgtccggcccgtcccgtaccggcctaccgcggaccggtacccgtccgtaccgacgacgaccgaccggccggaaaacccggccggtaccggtccggtcggtccggtaaccggg

SEQ ID NO: 177478 - DNA, 803 bp, Homo sapiens
  misc_feature: GYAE6OF01CPJYL.8.25.C03.1.454.CMB.1.raw
  modified_base (179)..(179): a, c, t, g, unknown or other
  misc_feature (179)..(179): n is a, c, g, or t
  modified_base (478)..(478): a, c, t, g, unknown or other
  misc_feature (478)..(478): n is a, c, g, or t
tcagctcgcgtgtccacgaccggtgctcgatttagtagtgtagatttgggtttgggtgccgaagttgctggaggtcacggtcaccacgctgctgagggagtagagtcctggaggcttggacagccgagggcggtccctggagctctcctgtacgagggactggtattcattcgtttggngactagtgtctgtacgaccgtcgggtcccgcgacggtcgtccggaagggggagggtctagggaggtaggggttaattctacgtaattaaggaaaacggtaagtctttaaggtggggtacggaaacaacgtaggtacttaccggcccgtagttcgtaggtaaggaaacggctaagtacttaccaacctattcccgaaagaggaatagtacgtaaacttaacgaaaacgcttacgtaccttaccctttaacgtaaactaaagaccgggtaacgacggtaacccgaaacggaaaaacccggnggaaccgtaacggtacgggtacgttactttaaacggttctacgggaaccgtttaagggttaggggtttaccgggtttaacggaaccttacggaaacgttaaacgtccgtacggttacggaccgggtaaccgtaccgggtaacctcggtacccgtaccgtccttccacgcccggtctacccggaccgtaaccgggccctacggttcccgttccccgtacccgcggccctaccgcgtcgtaaccgcggtaccgcccgtaccgtacggacgaccgacgtacccggaccggtccccggtaccggtcggccttccgggtcgtaacccggg

SEQ ID NO: 177479 - DNA, 511 bp, Homo sapiens
  misc_feature: GYAE6OF01BBJZ7.8.25.C03.1.454.CMB.1.raw
  modified_base (400)..(400): a, c, t, g, unknown or other
  misc_feature (400)..(400): n is a, c, g, or t
  modified_base (454)..(455): a, c, t, g, unknown or other
  misc_feature (454)..(455): n is a, c, g, or t
  modified_base (460)..(460): a, c, t, g, unknown or other
  misc_feature (460)..(460): n is a, c, g, or t
  modified_base (465)..(467): a, c, t, g, unknown or other
  misc_feature (465)..(467): n is a, c, g, or t
  modified_base (469)..(469): a, c, t, g, unknown or other
  misc_feature (469)..(469): n is a, c, g, or t
  modified_base (472)..(511): a, c, t, g, unknown or other
  misc_feature (472)..(511): n is a, c, g, or t
tcagctcgcgtgtccacgaccggtgctcgatttagtagtgtagatttgggtttggggcagggagtgggctaaggtgaggcaggtggcgccagccaggtgcacacccaatgcccgtgagcccagacactggaccctgcctggaccctcgtggatagacaagaaccgaggggcctctgcgcctgggcccagctctgtcccacaccgcggtcacatcggccacccacccttctcttcgccacgcccctacccgaacccgaaacggggccccaagttcccgggttccccttcccccgtggccccggtccctacgcctccgaaggacgtccacccgtcgagcgccaacgcgcccggcccgtgggtccctaggccgtaggtacgaacggtacctaccgtccgaacncggccgagccgtcggacggcgggtccgtagggaccgacgggcgaactagtaggnngagtnatcgnnngngcnnnnnnnnnnnnnnnnnnnnnnnnnnnnnnnnnnnnnnnn

SEQ ID NO: 177480 - DNA, 821 bp, Homo sapiens
  misc_feature: GYAE6OF01D464D.8.25.C03.1.454.CMB.1.raw
  modified_base (221)..(221): a, c, t, g, unknown or other
  misc_feature (221)..(221): n is a, c, g, or t
tcagctcgcgtgtccacgaccggtgctcgatttagtagtgtagattttgggtttggggagccgtgagattcccaggagtttccacttggtgatcagcactgaacacagaccaccaacatggtagtttgggcttacctgggtttttcctgttgtcttatttttaaaaggtgtccagttgtgaggtgcagtcgtggtgactcggttgggggagtcttggtacngccgagggcgtccctagactacgttctccgtgtaacgagggtacgttggacttctacttcgtttttaggagacttagtcgtacttggtccggtaccgttcggggtcccgcgtaggccgtaccggagggggacggtcgtggagggttaggttaacgttcctagtaagtaaggtaaaagtaacgtacgtttaggtaggggtacggaactaacgaacggttacgtaacccggccggtaggtaccttaggggttaaagacggtacgtagtaactttaccaaccgtaccgttcgtaacggaagtaggtaactagttaaccttaaaccgaaaacgtccttaacgtcctttacctttaaccaacgttaacggacgaacgacgtaccggaaacggtaaaccggagtaaccgaacggtcggtaactttaggttaacttacgtacggtaacgttaacggggtttagggttttacggggtaaacccgggtaaccgttaacccggtaaacctaaagttaccgggtacccgtacgggacgggttaccggaaacccgggttccgtacgttacccgtaccggttaccctacccgtccggccttaccccggacccg

SEQ ID NO: 177481 - DNA, 381 bp, Homo sapiens
  misc_feature: GYAE6OF02G6IDS.8.25.C03.1.454.CMB.1.raw
  modified_base (370)..(381): a, c, t, g, unknown or other
  misc_feature (370)..(381): n is a, c, g, or t
tcagctcgcgtgtccacgaccggtgctcgatttagtagtgtagatttgggtttggggcgagggagtgggctaaggtgaggcaggtggcgccagccaggtgcacacccaatgcccgtgagcccagacactggaccctgcctggaccctcgtggatagacaagaaccgaggggcctctgcgccctgggcccagctctgtcccacaccgcggtcacatggcaccacctctcttgcagcctccaccaagggcccatccggtcttccccctggcgccctgctccaggagcacctccgagagcacacgcggccctgggctgcctggtcaaggactactccgacacgcgagctgagcgggctggcaaggcgcatagnnnnnnnnnnnn

SEQ ID NO: 177482 - DNA, 549 bp, Homo sapiens
  misc_feature: GYAE6OF02IKAV3.8.25.C03.1.454.CMB.1.raw
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctagaaaaccgaggacacaggcgtgtattactgcaacaggttttggttacgggaaatccggacaaaatgacctcgtggggccagggaaccctggtccaccgtctcctcagcctccaccaagggcccatcgtcttccccngccnccctgctccaggacgccacctccgagacgccacgacgccggccctgggctcggccctcggg

SEQ ID NO: 177483 - DNA, 564 bp, Homo sapiens
  misc_feature: GYAE6OF02I1B61.8.25.C03.1.454.CMB.1.raw
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgttgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatgacagcctgaaaaccgaggacacaggcgtgtattactgacaacaggtttggttacgggaaatccgacaaaatgacctcgtgggccagggaaccctggtccaccgttctcctcacgccctccaccgaacgggcccagtccggtccttccccgtggcccgtccctcgcctccgacggacgcacccgtccgacgcgcacgacgcggccctgggcctcgccgtggtaccg

SEQ ID NO: 177484 - DNA, 255 bp, Homo sapiens
  misc_feature: GYAE6OF02HJMRR.8.25.C03.1.454.CMB.1.raw
  modified_base (249)..(255): a, c, t, g, unknown or other
  misc_feature (249)..(255): n is a, c, g, or t
tcagctcgcgtgtccacgaccggtgctcgatttagtagtgtagatttgggtttggttcgggaaatccgcaaaatgacctctggggccagggaaccctggtcaccgtctcctcagcctccaccaagggcccatcggtcttccccctggcgccctgctccaggagcacctccgagagcacagcggccctgggctgcctggtcaaggactacttccgacacgcgagctgagcgggctggcaaggcgcatagnnnnnnn

SEQ ID NO: 177485 - DNA, 604 bp, Homo sapiens
  misc_feature: GYAE6OF02GZQ9L.8.25.C03.1.454.CMB.1.raw
  modified_base (287)..(287): a, c, t, g, unknown or other
  misc_feature (287)..(287): n is a, c, g, or t
  modified_base (400)..(400): a, c, t, g, unknown or other
  misc_feature (400)..(400): n is a, c, g, or t
  modified_base (451)..(451): a, c, t, g, unknown or other
  misc_feature (451)..(451): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccnccaggctccgagggaaggggctggagtgggtaagtctcattagaagtaagcttagtggtagggacaacgagattacgccgacgtctgtgaaaggcagattcacatctacaagngatgactaccaaagcatcgtcctttcactaaatgacagacctagaaaccgngaacacgaggcgtgtattacgtgactaacgtaggtttcggtacggtaaactccgaactaaagttcggtaaccgttcggtaccggggaccgtaacggggtaaccccgttagggtaccctaccggtccttacccgtacgaccgtcccctaacccg

SEQ ID NO: 177486 - DNA, 646 bp, Homo sapiens
  misc_feature: GYAE6OF02G2AD1.8.25.C03.1.454.CMB.1.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (512)..(512): a, c, t, g, unknown or other
  misc_feature (512)..(512): n is a, c, g, or t
  modified_base (541)..(541): a, c, t, g, unknown or other
  misc_feature (541)..(541): n is a, c, g, or t
  modified_base (619)..(619): a, c, t, g, unknown or other
  misc_feature (619)..(619): n is a, c, g, or t
  modified_base (626)..(626): a, c, t, g, unknown or other
  misc_feature (626)..(626): n is a, c, g, or t
tcagctcgcgtgtccacgaccggtgctcgatttagtagtgtagatttgggtttgggggagccgtgagattcccgaggagtttccgacttggtgattcagcactgaacacagaccaccaaccatcggaggttggcttacctggtttccttgttgctatttaaaagtgtaccagtgtgaggtgtacagctggtggactcgtagggggaaggacttcggtaacacgccagggcgtccctgagactctctgtacgagggactggattcatcgtttggngactagtgctgtgtaccgtggtccncaggctccgaggggaggctggagtgggtaagtctactaagttagaaagtaaagtcttagtggtaggaacaaacagtacttacgccgtacgtctggacgaaacggctagtacgtaccaacgatcgtacgaaagagaagtagaacttaccgaaaagtctaactccgtacctttactaacgtaaagtcggaacacgtacccgtaacgaaaacccgngaaccacgacggtcgtagttacgttacgngaacgtaacgtgggtttacggacggaaactccggaataaacgtcgaaccgtcggcgggaccaacggtaccctggaccnccgttcncccgtacacgccctaacccg

SEQ ID NO: 177487 - DNA, 775 bp, Homo sapiens
  misc_feature: GYAE6OF02HJMZW.8.25.C03.1.454.CMB.1.raw
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactcgtggggggagcttggtacagccagggcggtccctgagactctcctgtacagggactggattcattctttggtgactatgctgtgacctgggtccgccaggctccgaggggagggctaggagtgggtaatctcattagaagtaaagcttagtgggtaggacaacgagacttaccggccgtcgtctagtagaaaggtcaaggtacttccaacctaatcctacgaaaggacgtaattacgtaactttaaccccgaaaaagtcctaaacgttcccggttacccctttttaactaaaccgtaaaagttcgggaaaccctaacggtaacccgttaaacggaaaaaacccgggagggtaaacccgaacgtaacggggtaccgttaggttaaactttaaccgcggtaaccgttaaacggttacggggttttttacggggttaaccgggaaaaacgttccccggaaataaaacgttccggtaacccgttccgggttaccggggggaccccttaaacgggggaacccccgtttgggtaccccgtaccccgggttacccttcccggtacccgaaccggtcccctaaccccgg

SEQ ID NO: 177488 - DNA, 615 bp, Homo sapiens
  misc_feature: GYAE6OF02F7OXZ.8.25.C03.1.454.CMB.1.raw
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (488)..(488): a, c, t, g, unknown or other
  misc_feature (488)..(488): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactcgtggggggaggcttggtacagccagggcggtccctgagactctcctgtacagggactggattcattctttggtgactatgctgtgacctgggtccnccaggctccgaggggaaggggctgggagtgggtaatctnattagaagtaaagcttanggtggacaacagattacgccgngtctgtagaaaggcagattcacatctacaagagatgattaccaaaagcaatcgtacctttacaacaaagtcggaacagacctagaaaaccgaggaacacacgggcgttagtaattacgngacaacgtagggtttaggttacgggaaatcccgaataaactcgaacccgtcggtacggggaccctaacggggtaaccccttgggtaaccgtacccgttacctcccgtaccgaccgtcccctaacccg

SEQ ID NO: 177489 - DNA, 603 bp, Homo sapiens
  misc_feature: GYAE6OF02HRLV6.8.25.C03.1.454.CMB.1.raw
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
tcagctcgcgtgtccacgaccggtgctcgatttagtagtgtagatttgggtttggggagccgtgagattcccaggagtttccacttggtgatcagcactgaacacagacccaccaaccatggagtttgggcttacctgggttttccttgttgctattttaaaaggtgtccagtgtgaggtgcagctggtggactcgtggggggagcttggtacagccagggcggtccctgagactctcctgtacagggactggattcattctttggtgactatgctgtgaccgtgggtccgccaggctccgaggggaggggctgggagtgggtaagtctcattaggaagtaagcttagtgggtagggaacaacgagtattacgccgcgtctgtagaaggcagatcacatcacaagagatgacttaccaaagcatccgtcctttactaacaagtcggacagacctaagaaaaccgnggacacgaggtcgtagtattacgngtaacaagttagggtttcgggtaacggaaactccgaataaacgtcgaccgtcggtacggggccaacggggtaccctggtacccaccgttcctcccgtacaccgtccctaacccg

SEQ ID NO: 177490 - DNA, 636 bp, Homo sapiens
  misc_feature: GYAE6OF02GNUQK.8.25.C03.1.454.CMB.1.raw
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
  modified_base (493)..(493): a, c, t, g, unknown or other
  misc_feature (493)..(493): n is a, c, g, or t
tcagctcgcgtgtccacgaccggtgctcgatttagtagtgtagatttgggtttggggagccgtgagattccccaggagtttccacttggtgatcagcactgaacacagaccaccaaccatggagtttgggcttacctgggttttccttgttgctattttaaaaggtgtccagtgtgaggtgcagctggtggactcgtggggggagcttggtacagccgagggcggtccctgagactctcctgtacagggactggattcattcttggtgactatgctgtgaccgtgggtcccgccaggcctccggaaggggaacgggcgtgggaggtgggtaagtctacaagttagaaagtaaatcgtttaagtgggtagggaacaacaggtacttaccggccgtcgtgtagtagaaaggnagtatccaacatctacaagganatgtactaaccaaagctatcgtacctttactaacaatcggacaagtccgtaagaaaccggngaacgacaggtcgtagttaactacgtgactaacgttagggtttaggtaacggtaactccgaactaacgtcgaccgttaccggagggacccgtacgggacccttcggtaccgtccgtaccgtcctacgaccgtcccaaccccgg

SEQ ID NO: 177491 - DNA, 757 bp, Homo sapiens
  misc_feature: GYAE6OF02JUV4V.8.25.C03.1.454.CMB.1.raw
  modified_base (213)..(213): a, c, t, g, unknown or other
  misc_feature (213)..(213): n is a, c, g, or t
tcagctcgcgtgtccacgaccggtgctcgatttagtagtgtagatttgggtttggggagccgtgagattcccaggacgtttccacttggtgatcagcactgaacacagaccaccaaccatggagtttgggcttacctgggttttcctgttgcttattttaaaggtgtcagtgtagaggtgcagctggtggactcgtgggggagctttaggacngccgaggggccggtccctggacgtacctctcctgtacacgggtactgggtacttccagttcgtttggtagtaccttagtcggtcttaggtcggtaccgttcggggttcccacggtacggtcctaccgggaagggggaacggggtcctaggggtacggttaagggttaaggtcccttagtaaggtttaaggaaacgttaaacggtctttaaggtcggggttaacggaaactaaccgtagtaacgttacccggaccgttctcgtaggaggaacgtcgtaacgtacttcaacctataccgacgtaaagcgtaatcgtaactaaccgtaaataccgtaactaccggttacccttacgtaacctaaaggtaccgtacgtaccgtacgtaacgaacggaacgactaacgacgtacgtgtactccgtagtacgtacgttagttacggtacgtaacgttacgacgttaagcgtaacgtcggtacgggtaccgtacggtacccgttacgtaccgtaccggtacccgtacccgtcgtaccgtcccgtaacccgg

SEQ ID NO: 177492 - DNA, 799 bp, Homo sapiens
  misc_feature: GYAE6OF02I5K2M.8.25.C03.1.454.CMB.1.raw
  modified_base (274)..(274): a, c, t, g, unknown or other
  misc_feature (274)..(274): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggaggcttgggtacaggccaggggccggtccctggagactctcctgtacgagggactggattcattcgtttgggngtactatgctggtcgaccgtgggtcccgcgaggcctcgaggggaacggggctgggaggtgggtaacgtctactagttaaggaagtaaaagtcttaagtgggtacgggaacaaacgtacgtaattaccggccgtacgtcgtagtaggaaaagggcaaggtacttacgaacctagtactacaaaggacgtatacggtaacttaaccgtaaaaagctaacgtaccgttaccctttacgtaaaacgtaaagtacggtaaccgtaacgtaaccccgttaaaggaaaaacccggaacggtaacgaaccgtacgggtacggttacgttaaacttaccgtagaacccgttaaacggttaggggttttaccgggtaaacgggaaaacgttcccggaaagtaaacgttccggtaacccgttccgggtaacggggtaccccgaaaaccgggggtaaccccgttttacggggtaccccgtaaccccggttttacctacccccggttacggtaaccccgtaccccgttaaacccccgg

SEQ ID NO: 177493 - DNA, 728 bp, Homo sapiens
  misc_feature: GYAE6OF02IKNXR.8.25.C03.1.454.CMB.1.raw
  modified_base (264)..(264): a, c, t, g, unknown or other
  misc_feature (264)..(264): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
tcagctcgcgtgtccacgaccggtgctcgatttagtagtgtagatttgggtttggggagccgtgagattcccaggagtttccacttggtgatcagcactgaacacagaccaccaaccatggagtttgggcttacctgggttttccttgttgctattttaaaaggtgtccagtgtgaggtgcagctggtggactgtgggggaggcttggtacagccgagggcggtccctgagctctcctgtacagggctggattcattctttggnactatgctgtcgaccgtgggtcccgcgacggcctaccgaggggaaggggctgggaggttggggtggacgttaggtttgtttcagttcgtaggagggntagtgtttacaagtggtatgctggacgtccgtaggaacggcctnttccacctatccaccgagtacgaacctaacctaccgaaggaaaccaacgtaaacgttaggttacgtttacggtaacccgtacgtaaaccgacgtaaccgtttaacggttccgtaggtaaccgggacgggtaacgggtagttaacgttaacgttacggtacggtaaacggggaacggggaacggggggaacccgtaagggaccggggtaacgttaccgtaacggttacgttacccgtttaggtcggtaccggttacgggggacccgtacgggtacccgttcgggtacccgtacccggttccctaccgttaccgacgtacccccg

SEQ ID NO: 177494 - DNA, 681 bp, Homo sapiens
  misc_feature: GYAE6OF02HH7UG.8.25.C03.1.454.CMB.1.raw
  modified_base (469)..(469): a, c, t, g, unknown or other
  misc_feature (469)..(469): n is a, c, g, or t
tcagctcgcgtgtccacgaccggtgctcgatttagtagtgtagatttgggtttggggagccgtgagattcccaggagtttccacttggtgatcagcactgaacacagaccaccaaaccatggagtttgggcttacctgggttttccttgttgctattttaaaaggtgtccagtgtgaggtgcagctggtggactcgtggggggaggcttgggtacagccgaggggcggtccctgagactctcctgtacagggactggattcattcgttttggtgacttatgcttggtcgaccgttggggtcccgcctagggcctaccggaagggggaacgggggctggggaggttagggggtaatctcaattaaggaaaggtaaagtcttaggtgggtagggaacaacgagtagttaccgccgtcgtctggtaggaaaggcagtattccacctatcagaggagatagtacttaacaaancaatcctacctttactaactaaagtcggaacacgtacctaacggaaaaccgacggaacacgagggtcgttaaggttattacgtacgacgtaacggttacgggttttacgggtacggaaactccgaacgtaacgtcgaaccggttcggaccggggtaccgtaaccgggtacccgtgggacctaccggtcctacccgctaccgtcctaccccgg

SEQ ID NO: 177495 - DNA, 836 bp, Homo sapiens
  misc_feature: GYAE6OF02I1D3R.8.25.C03.1.454.CMB.1.raw
  modified_base (200)..(200): a, c, t, g, unknown or other
  misc_feature (200)..(200): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattcgtttggtgactatgctgtcgacctgggtccncgaggcctaccgaggggaacgggctggaggtgggtaatctacgaattaagaagtaaagcttagtgggtaggaacaacgagtacttaccgccgtcgtctggtagaaaggcaagtcttcacctatctacgaagacgtagtagtaacttaaccgaaaagtcctaacgttaccgttacctttaacgtaaacgtaaaggtcggaacgtaacgtacccgttaaacggaaaaacccggaggaacctaacgggacggtaccgtttagttaaacttacgttacggaaccgtaaaggtttacggggttttacggttaaaccggggtaaaccttacccggaaacttaaaacgttccggtaaacccgttcgggtaaccggggaacccgggttaaccggggtaaccccgttacggttacccgtaaccgttcccgtaccgtaccgaacccgttacccgtaacccgaaccggtaaccgggtcccttaaccggttcccgtttaccccgttaccccggtacggtccccgtacccgttcgtacccgtacccgtacggtacccgtacccggaaccccgttccggaacgtacccgaccggtacccgtaccgggcccggtacccggtacggcccggttacggtcccggttaaccggg

SEQ ID NO: 177496 - DNA, 637 bp, Homo sapiens
  misc_feature: GYAE6OF02GZ7SV.8.25.C03.1.454.CMB.1.raw
  modified_base (363)..(363): a, c, t, g, unknown or other
  misc_feature (363)..(363): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (539)..(539): a, c, t, g, unknown or other
  misc_feature (539)..(539): n is a, c, g, or t
  modified_base (575)..(575): a, c, t, g, unknown or other
  misc_feature (575)..(575): n is a, c, g, or t
tcagctcgcgtgtccacgaccggtgctcgatttagtagtgtagatttgggtttgggcagggagtgggctaaggtgaggcaggtggcgccagccaggtgcacacccaatgcccgtgagcccagacactggaccctgcctggaccctcgtggatagacaagaaccggagggcctctgcgccctggcccagctctcgtccacgaccgcggtcactacgtcggccaccgtacctcgttacttcgaccgtacgccctacccgaccgaacgggccccagttccggtaccttcccccgtggccctacccgtgcccgttccagggactccaccgtccgaatcgccaacgtcggaccggcccgtggggtccncggtcccggtggtaccgaacggtcctaaccgttccgaacgtcccggngtacgccgtacggacggccgggtagtcggaccggaagtcccgacgtagtaacggtccncgaagcgtgactcgcntcgctcggtnacgtccgaancccgancgttacancggcngtcgcgacaggtaccncgagcgtcgaacgctacggtcacgtcgcgtacgtcncggtaaccgtcgtactcggtaccgtacgtcggaacctctacccggtaagtccgtaggtaccg

SEQ ID NO: 177497 - DNA, 763 bp, Homo sapiens
  misc_feature: GYAE6OF02H8A21.8.25.C03.1.454.CMB.1.raw
  modified_base (433)..(433): a, c, t, g, unknown or other
  misc_feature (433)..(433): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcattctttggtgactatgctgtgaccgtgggtccgccaggctccgaggggagggctggagtggtaagtctcattaagaaagtaaagtcttagtgggtagggacaacgagacttacgccgcgtctgtagaaaggcagtattcaccatcgtacaagagtatgattaccaaaagctagtccgtacctttactaacaaagtcggaacacggtaccctaacggaaaaacccggtaggaacccaacgacgggtacgtttaggttaactttaccgngtaccgtaaacggttaggggtttttcgggttaacgggtaaacgtacccggtaaactaaaacgttcgtaacccgttacggtcggggacccggtaaacgggtaaccccgttcggtacccgtaccgttcccttacccgtacgaccgtcccctacccgaacccggtaaccggggcccctaacggtttcccggttaccccgtttacccccggtcgggtccccgtcccgtcggtacccgtacccggacgggtacccgcccgtaacccggtccggaacgacccgaccaccggaccggcccgggtccccgttggggaccttccggacccgttaccggg

SEQ ID NO: 177498 - DNA, 411 bp, Homo sapiens
  misc_feature: GYAE6OF02IB5D1.8.25.C03.1.454.CMB.1.raw
  modified_base (270)..(270): a, c, t, g, unknown or other
  misc_feature (270)..(270): n is a, c, g, or t
  modified_base (399)..(411): a, c, t, g, unknown or other
  misc_feature (399)..(411): n is a, c, g, or t
tcagctcgcgtgtccacgaccggtgctcgatttagtagtgtagatttgggtttggggcagggagtgggctaaggtgaggcaggtggcgccagccaggtgcacacccaatgcccgtgagcccagacactggaccctgcctggaccctcgtggatagacaagaaccgaggggcctctgcgccctgggcccagctctgtcccacaccggcggtcacatggcaccacctctcttgcagcctccaccaaggcccagtccgtccttcccctggccnccccgtgctccgacggagccaccctccggatacgcaacgaggccggccccgtgggacctcgccgttggtcaacgggtacttaccttccgacgacgcgagcgtggacggtcgggctggcgagcgcatagnnnnnnnnnnnnn

SEQ ID NO: 177499 - DNA, 751 bp, Homo sapiens
  misc_feature: GYAE6OF02IUG4S.8.25.C03.1.454.CMB.1.raw
  modified_base (164)..(164): a, c, t, g, unknown or other
  misc_feature (164)..(164): n is a, c, g, or t
  modified_base (211)..(211): a, c, t, g, unknown or other
  misc_feature (211)..(211): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
tcagctcgcgtgtccacgaccggtgctcgatttagtagtgtagatttgggtttgggggagccgtgagattcccaggagtttccacttggtgatcagcactgaacacaggaccaccaaccatggagtttggcttacctggttttcttgttgctattttaaaaggngtccagtgtgaggtgcagctggtggactcgtgggggagcttggtacngccagggcggtccctgagactctctgtacgaggctggattcattctttggngtactatgctgtgaccgttgggtacccncgagtctcgaaggggaacgggtctggagtaggtaagtccgtgaagttaagaagtaacgtcgtttagtgggtaggaaccaacgtagtacttaccggccgtcgtnttacggagaaacggcaggtacttccgaactntacaanaggatctatactacaaaacgtnacgttctacctttactaacgtaagtcgaacgtacgtaccgtaaccgaaaacggtcgaacgtaaccgacggtaccgtaaaggttaccgtttacgtacgtaacgtaacggttaggggttttaaccgggttaaacgggttaaacgttacccggttaacgtaaaacgtacccggttaacccgttaccgggttaacccgggggaaccgtaaccccggggttaacccggtttaacccggttacccgttaacccgggtttccccgttaccccgtacggtaccccggttacccccgttaacccccgg

SEQ ID NO: 177500 - DNA, 665 bp, Homo sapiens
  misc_feature: GYAE6OF02GJRZR.8.25.C03.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
tcagctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacgagggactggattcattctttggtgactatgctgtgacctgggtccnccaggctccgaggggaagggctggagtgggtaagtctntattagaaagtaagtnttagtggaggacaacagattcgccgngtctgtagaaggcagattcacatctanaagagatagattaccaaaagcatccgtctttacaacaaagtcggacacgacctaagaaaccggagacacgagngtgtaattcngacgaagttgggtttacggtacgaagtccgaactaaaagtcgtaaccgtacgtacgggacccgaacgggtaaccctcggtacctacccggttcctccgccgacgccctaccgaaccggaccgggaccctgttcccggttccccgttacccccgtcgggtccccgtcccgtccgtaccgtacccgaggacccgtcccgtaacccggtacccggaacgaccggaccgaccggacgtcccggggacccgttcggggaccttccgggtaccgtaccgggg

SEQ ID NO: 177501 - DNA, 957 bp, Homo sapiens
  misc_feature: GYAE6OF02G2N5Z.8.25.C03.1.454.CMB.1.raw
  modified_base (164)..(164): a, c, t, g, unknown or other
  misc_feature (164)..(164): n is a, c, g, or t
tcagctcgcgtgtccacgaccggtgctcgatttagtagtgtagatttgggtttggggagccgtgagattcccaggagtttccacttggtgatcagcaactgaacacagaccaccaaccatggagtttggttacctgggttttccttgtgcttatttaaaaggtntccagtgtgaggtgcagctggtgactcggtagggggagtcgttaggtacagccgagggtccgtcctagacgactccgtctgtacgaggggtactggtacttctaagttcgtttagggtactacgttatcgtacgtgttccgacgtttcggggaccctaccgaggtaccgtacggaacggggaacggggtccgtgggtaagggtagggttaaactccgttaagtaacttaaaggaaacggtttaaacgcttttaacgggtgggttacggaaacctaacgtaaggtaacgtttaacccggcccgtgttacggtaaggtaacggaaacggggtactaaggttaaccctacgtaaaccgtacctttaacgaaccgtaaagggtaacggtactttaacgggtaaacctaaaacccggaaaacggtaccctaaacgggttccctacccgttttaaaccgaaacgttaaacggttcgggaaacgacccggtttaacccggaaaaacgggaaacccggtaaaccgggtaactaaacccggggtaaggttaaccgtttaacgggtaaacggtttacccgtaccggttaaaacgttaacggttttaaccggggggttttaaacggggttaaccggttaaaaccgttaaacccgggaaattttaaaaaccgggccgggtttaccgtaaccggggttaccggggttaaccccgggtaaaaccgggttccccgttaaccggtaacccggttacccgttacccggtacccttaacggtaccccgtaccgttacccggaaaccccggg

SEQ ID NO: 177502 - DNA, 733 bp, Homo sapiens
  misc_feature: GYAE6OF01C7LDG.41.10.A10.1.454.CMB.1.raw
tcagtctatactatcacgaccggtgctcgatttagcgtcgatctcagggggtcagtctcagtcaggacacagcatggacatgagggtccccgctcagctcctggggctcctgctactctggctccgaggtgccagatgtgacatccagatgacccagtcctcccttcctccctgtctgtcttctataggagacagagtcgccatcacttggccgggcaagtcagaccattaacagtctaatttaaattggtatcagcagagaccgagggaaacgcccctagaacctcctgactctctgctcgcctccactcgtcgacgtaaggtggtacgttcttaccgtttacgtaaacgggtttccgaagggttcggacgtaaggttcgggacgttcggtaggggtaactaggttacttttccaacctttcctacctaaccctacttccttaccgtacgttacctacgtaacctaaaccgttaggtaacgttacgtttttacgaaccttaacttttaaccttaacgttacgttaacctaaacgtaacgtttaacgtttaaccttaccgttacccggttacccccgtttacggtttaacccgggtttttcggggaaccccggggggttaaaccctaacgggtaccggttaagggaaccgtaaacgttaacccgtaaaaacgggttaaccgttagggtaccgtacgtacggtacccctaaccgttacttccgttcgtttaccg

SEQ ID NO: 177503 - DNA, 831 bp, Homo sapiens
  misc_feature: GYAE6OF01CMEA1.41.10.A10.1.454.CMB.1.raw
  modified_base (241)..(241): a, c, t, g, unknown or other
  misc_feature (241)..(241): n is a, c, g, or t
tcagtctatactatcacgaccggtgctcgatttagcgtcgatctcagggggtcagtctcagtcaggacacagcatggacatgagggtccccgctcagctccgtggggctcctgctactctggctcccaggttcgagatgtgacatcgagatcgacccagtcctccttccttctgtcttcttctgtggagcagcgtcaccatcgacgttcggccgggcgtagtcgtacggttcgttttcggngtccgttggttcgtccgtttagggtttaaccgaaaaacggggaaaaaaggggggtcgtaaccgggtaccccgttaaagggttcccctacggttccttacgtaccggttaacggaaaaccctaggtaaccggtagggaaaacggttcgaaccggttccccgtacgtagggttccaaggtcgacccgtaggtccggtaggggttcgggcgggtaccggtaacgtcccgtacgtaccgttaaccgaaccgtagttaccggccgtaaccgtcggaccggtaccgtaggaaacgttcgtttacgtacgtaaccttaacgtttacgtttaccgtacgtacgtaacgtacgtaagtactaacgtacgtaccggttacccgtacccgtttacgttaacgggttttaccgggaacccggtaacggggtaacctaacggtaccggttaaacgggtaaaactaaccggtaaaacggtaccggttaggttacccggactaccggaacctaaccgttaccgttaccggttcttacccgttccgtacccgtttacccgttaccccggtaacttacgttagttacggtaattaacggttaacccg

SEQ ID NO: 177504 - DNA, 501 bp, Homo sapiens
  misc_feature: GYAE6OF02G8588.41.10.A10.1.454.CMB.1.raw
  modified_base (369)..(369): a, c, t, g, unknown or other
  misc_feature (369)..(369): n is a, c, g, or t
  modified_base (432)..(432): a, c, t, g, unknown or other
  misc_feature (432)..(432): n is a, c, g, or t
tcagtctatactatcacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtgagtctcttcaaggttcagtgcagtggatcgtggacagatttcactctcaccatctcagtcngcaacctgaagtattttgactaacttactactgtacaacagtagttatactcgtccccgtttntacgttttggccggggtactaagcgtaggacgtatacgaaacgtactggtagctcgcaccacttctgtc

SEQ ID NO: 177505 - DNA, 463 bp, Homo sapiens
  misc_feature: GYAE6OF01ECBO2.42.36.D03.1.454.CMB.1.raw
  modified_base (412)..(415): a, c, t, g, unknown or other
  misc_feature (412)..(415): n is a, c, g, or t
  modified_base (418)..(463): a, c, t, g, unknown or other
  misc_feature (418)..(463): n is a, c, g, or t
tcagtgacgtatgtcacgaccggtgctcgatttagctgcgtcacgtaagtctctgcacagaactttcaggggctgggtcaccatgaccagggacacgtccatcaaaacagcctctctggagctgaccagactgagatctgacgacacgggccgtgtacttacgtgtgcgacgagagggtactacatacggtctggacgtcgtggggccaaaggggaccaacgggtcaccgtctacctcagccctaccaccaaagggtccccattccggtccttaccccctggccacccctcctccaagacggcaacctcgtggggacacacgcggcctgggctgccctggcaaggctacgttccaacataacgtcacgtcgacggccgggctcgggcgaaacggcggcctaaatcggacagnnnncannnnnnnnnnnnnnnnnnnnnnnnnnnnnnnnnnnnnnnnnnnnnn

SEQ ID NO: 177506 - DNA, 142 bp, Homo sapiens
  misc_feature: GYAE6OF02IENEA.42.36.D03.1.454.CMB.1.raw
  modified_base (139)..(142): a, c, t, g, unknown or other
  misc_feature (139)..(142): n is a, c, g, or t
tcagtgacgtatgtcacgaccggtgctcgatttagctgcgtcacgatctctcttgggtcagtgatacgtcttcctgcaggacgctcacctctccgctgcaggaagacgtatcactgagcgggctggcaaggcgcatagnnnn

SEQ ID NO: 177507 - DNA, 156 bp, Homo sapiens
  misc_feature: GYAE6OF01B7PRC.33.10.A10.1.454.CMB.1.raw
  modified_base (154)..(156): a, c, t, g, unknown or other
  misc_feature (154)..(156): n is a, c, g, or t
tcagtacacacactcacgaccggtgctcgattagcgtcgatctcaggtcttccctggcacctcctccaagagcacctctgggcacagcggcctggctgcctggtcaaggactacttccagtgtgtgtactgagcgggctggcaaggcgcatagnnn

SEQ ID NO: 177508 - DNA, 199 bp, Homo sapiens
  misc_feature: GYAE6OF01ECB8F.33.10.A10.1.454.CMB.1.raw
  modified_base (198)..(199): a, c, t, g, unknown or other
  misc_feature (198)..(199): n is a, c, g, or t
tcagtacacacactcacgaccggtgctcgatttagcgtcgatctcagggtccgggagatcatgagggtgtccttgggtttggggaagaggaagactgacggtccccaggagttcaggtgctgggcacagcggccctgggctgcctggtcaaggactacttccagtgtgtgtactgagcgggctggcaaggcgcatagnn

SEQ ID NO: 177509 - DNA, 250 bp, Homo sapiens
  misc_feature: GYAE6OF01B3EL5.33.10.A10.1.454.CMB.1.raw
  modified_base (202)..(207): a, c, t, g, unknown or other
  misc_feature (202)..(207): n is a, c, g, or t
  modified_base (209)..(250): a, c, t, g, unknown or other
  misc_feature (209)..(250): n is a, c, g, or t
tcagtacacacactcacgaccggtgctcgatttagcgtcgatctcaggggtccgggagatcatgagggtgtccttgggttttggggaagaggaagactgacggtcccccaggagttcaggtgctgggcacagcggccctgggctgcctaggtcaaggactacttccagtgtgtgtactgagcgggctggcaaggcgcatagnnnnnncnnnnnnnnnnnnnnnnnnnnnnnnnnnnnnnnnnnnnnnnnn

SEQ ID NO: 177510 - DNA, 202 bp, Homo sapiens
  misc_feature: GYAE6OF01DZIM3.33.10.A10.1.454.CMB.1.raw
  modified_base (201)..(202): a, c, t, g, unknown or other
  misc_feature (201)..(202): n is a, c, g, or t
tcagtacacacactcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnn

SEQ ID NO: 177511 - DNA, 198 bp, Homo sapiens
  misc_feature: GYAE6OF01CCKFS.33.10.A10.1.454.CMB.1.raw
  modified_base (196)..(198): a, c, t, g, unknown or other
  misc_feature (196)..(198): n is a, c, g, or t
tcagtacacacactcacgaccggtgctcgatttagcgtcgatctcagggtccggagatcatgaggtgtccttgggtttggggaagaggaagactgacggtcccccaggagttcaggtgctgggcacagcggccctgggctgcctggtcaaggactacttcagtgtgtgtactgagcgggctggcaaggcgcatagnnn

SEQ ID NO: 177512 - DNA, 204 bp, Homo sapiens
  misc_feature: GYAE6OF01BRH93.33.10.A10.1.454.CMB.1.raw
  modified_base (201)..(204): a, c, t, g, unknown or other
  misc_feature (201)..(204): n is a, c, g, or t
tcagtacacacactcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177513 - DNA, 204 bp, Homo sapiens; identical to SEQ ID NO: 177512
  misc_feature: GYAE6OF01B0OPA.33.10.A10.1.454.CMB.1.raw
  modified_base (201)..(204): a, c, t, g, unknown or other
  misc_feature (201)..(204): n is a, c, g, or t

SEQ ID NO: 177514 - DNA, 237 bp, Homo sapiens
  misc_feature: GYAE6OF01BTXHH.33.10.A10.1.454.CMB.1.raw
  modified_base (199)..(199): a, c, t, g, unknown or other
  misc_feature (199)..(199): n is a, c, g, or t
  modified_base (205)..(237): a, c, t, g, unknown or other
  misc_feature (205)..(237): n is a, c, g, or t
tcagtacacacactcacgaccggtgctcgatttagcgtcgatctcaggggttccgggaggatcatgagggtgtccgttgggttttgggggaagaggaagactagacggtcccccaggagttcacggtgctgggcacagcggcctggctgcctggtcaaggactacttccagtgtgtgtactgagcgggctggcaaggcncatagnnnnnnnnnnnnnnnnnnnnnnnnnnnnnnnnn

SEQ ID NO: 177515 - DNA, 206 bp, Homo sapiens
  misc_feature: GYAE6OF01AKSYK.33.10.A10.1.454.CMB.1.raw
  modified_base (201)..(206): a, c, t, g, unknown or other
  misc_feature (201)..(206): n is a, c, g, or t
tcagtacacacactcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccagtgtgtgtactgagcgggctggcaaggcgcatagnnnnnn

SEQ ID NO: 177516 - DNA, 205 bp, Homo sapiens
  misc_feature: GYAE6OF01AUZS5.33.10.A10.1.454.CMB.1.raw
  modified_base (201)..(205): a, c, t, g, unknown or other
  misc_feature (201)..(205): n is a, c, g, or t
tcagtacacacactcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 177517 - DNA, 210 bp, Homo sapiens
  misc_feature: GYAE6OF01DYOHJ.33.10.A10.1.454.CMB.1.raw
  modified_base (201)..(210): a, c, t, g, unknown or other
  misc_feature (201)..(210): n is a, c, g, or t
tcagtacacacactcacgaccggtgctcgatttagcgtcgatctcgaggggtccgggagatcatgagggtgtccttgggtttgggggaagaggaagactgacggtcccccaggagttcaggtgctgggcacagcggccctgggctgcctggtcaaggctacttccagtgtgtgtactgagcgggctggcaaggcgcatagnnnnnnnnnn

SEQ ID NO: 177518 - DNA, 204 bp, Homo sapiens; identical to SEQ ID NO: 177512
  misc_feature: GYAE6OF01BJMWD.33.10.A10.1.454.CMB.1.raw
  modified_base (201)..(204): a, c, t, g, unknown or other
  misc_feature (201)..(204): n is a, c, g, or t

SEQ ID NO: 177519 - DNA, 207 bp, Homo sapiens
  misc_feature: GYAE6OF01BRYYV.33.10.A10.1.454.CMB.1.raw
  modified_base (199)..(207): a, c, t, g, unknown or other
  misc_feature (199)..(207): n is a, c, g, or t
tcagtacacacactcacgaccggtgctcgatttagcgtcgatctcaggggtccgggagatcatgagggtgtccttgggtttggggaagaggaagactgacggtcccccaggagttcaggtgctggcacagcggcctgggctgcctggtcaaggtctacttccagtgtagtgtactgagcgggctggcaaggcgcatagnnnnnnnnn

SEQ ID NO: 177520 - DNA, 204 bp, Homo sapiens
  misc_feature: GYAE6OF01CYUR9.33.10.A10.1.454.CMB.1.raw
  modified_base (200)..(204): a, c, t, g, unknown or other
  misc_feature (200)..(204): n is a, c, g, or t
tcagtacacacactcacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 177521 - DNA, 203 bp, Homo sapiens
  misc_feature: GYAE6OF01CJ2FA.33.10.A10.1.454.CMB.1.raw
  modified_base (200)..(203): a, c, t, g, unknown or other
  misc_feature (200)..(203): n is a, c, g, or t
tcagtacacacactcacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177522 - DNA, 203 bp, Homo sapiens
  misc_feature: GYAE6OF01A9WHA.33.10.A10.1.454.CMB.1.raw
  modified_base (201)..(203): a, c, t, g, unknown or other
  misc_feature (201)..(203): n is a, c, g, or t
tcagtacacacactcacgaccggtgctcgatttagcgtcgatctcagggtccgggagatcatgagggtgtccttgggtttgggggaagaggaagactgacggtccccccaggagttcaggtgctgggcacagcggccctgggctgcctggtcaaggactacttccagtgtgtgtactgagcgggctggcaaggcgcatagnnn

SEQ ID NO: 177523 - DNA, 521 bp, Homo sapiens
  misc_feature: GYAE6OF01A8X26.33.10.A10.1.454.CMB.1.raw
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgatgaaaataaatactatgcggactccgtgaagggccgattcagcatctccagagacaattccaagaacacgttgtatctgcaaatgaacggtgtgagacctgacgacacggctgtgtatttctgtgacgaaagnttattacgatgatttgactggttactntgagggtgtggcgacgtgggccagggacctggtcatcgtctcctcacgcctccaccgaacggcccacgtccggtccttccccctcggcccaccctcctccaacgacgccacccgtcgtggggcacgcgcggcccgtgggctggcctggtcgaacgg

SEQ ID NO: 177524 - DNA, 217 bp, Homo sapiens
  misc_feature: GYAE6OF01EFFJ6.33.10.A10.1.454.CMB.1.raw
  modified_base (205)..(217): a, c, t, g, unknown or other
  misc_feature (205)..(217): n is a, c, g, or t
tcagtacacacactcacgaccggtgctcgatttagcgtcgatctcgaggggtccgggagatcatgagggtgtccttgggttttgggggaagaggaagactgacggtcccccaggagttcaggtgctgggcacacgcggccctgggctgcctggtcaaggactacttccgagtgtgtgtactgagcgggctggcaaggcgcatagnnnnnnnnnnnnn

SEQ ID NO: 177525 - DNA, 206 bp, Homo sapiens
  misc_feature: GYAE6OF01DS84L.33.10.A10.1.454.CMB.1.raw
  modified_base (203)..(206): a, c, t, g, unknown or other
  misc_feature (203)..(206): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagnnnn

SEQ ID NO: 177526 - DNA, 215 bp, Homo sapiens
  misc_feature: GYAE6OF01EO5SA.33.10.A10.1.454.CMB.1.raw
  modified_base (201)..(215): a, c, t, g, unknown or other
  misc_feature (201)..(215): n is a, c, g, or t
tcagtacacacactcacgaccggtgctcgatttagcgtcgatctcagggtccgggagatcatgagggtgtccttgggttttgggggaagaggaagactgacggtccccccaggagttcaggtgctgggcacagcggccctgggctgcctggtcaaggctacttccagtgtgtgtactgagcgggctggcaaggcgcatagnnnnnnnnnnnnnnn

SEQ ID NO: 177527 - DNA, 203 bp, Homo sapiens
  misc_feature: GYAE6OF01E6B3K.33.10.A10.1.454.CMB.1.raw
  modified_base (201)..(203): a, c, t, g, unknown or other
  misc_feature (201)..(203): n is a, c, g, or t
tcagtacacacactcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 177528 - DNA, 206 bp, Homo sapiens; identical to SEQ ID NO: 177525
  misc_feature: GYAE6OF01D8FPD.33.10.A10.1.454.CMB.1.raw
  modified_base (203)..(206): a, c, t, g, unknown or other
  misc_feature (203)..(206): n is a, c, g, or t

SEQ ID NO: 177529 - DNA, 207 bp, Homo sapiens
  misc_feature: GYAE6OF01CREMF.33.10.A10.1.454.CMB.1.raw
  modified_base (203)..(207): a, c, t, g, unknown or other
  misc_feature (203)..(207): n is a, c, g, or t
tcagtacacacactcacgaccggtgctcgatttagcgtcgatctcaggggtccgggagatcatgagggtgtccttgggttttgggggaagaggaagactgaccggtcccccaggagttcaggtgctgggcacagcggccctgggctgcctggtcaaggactacttccagtgtgtgtactgagcgggctggcaaggcgcatagnnnnn

SEQ ID NO: 177530 - DNA, 206 bp, Homo sapiens; identical to SEQ ID NO: 177525
  misc_feature: GYAE6OF01A384B.33.10.A10.1.454.CMB.1.raw
  modified_base (203)..(206): a, c, t, g, unknown or other
  misc_feature (203)..(206): n is a, c, g, or t

SEQ ID NO: 177531 - DNA, 575 bp, Homo sapiens
  misc_feature: GYAE6OF01CTJWB.33.10.A10.1.454.CMB.1.raw
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (392)..(392): a, c, t, g, unknown or other
  misc_feature (392)..(392): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagcctggggggtccctgagactctcctgtgcagcctctggattcaccttcagttactatggcatgcactgggtccgccaggctccaggcaaggggctggagtggctatcagttatatcacatgatagaaaataatactatgcgactcgtgaaggccatcagcatctcaganacaatcaagacacgttnatctgacaagtgaacggtgtgaagtacctgacgacgacggtctggttntatttcgtgtagacgtaaagtactttaagttacgaattagtattttgacgttggtttaactcgttgggtaagggggttctagggacggtaccggtggggggtaccctaagggggtaaccccgttggggtaccctacgttccgtcccttacccgttcaaccggtccccttacccgaaacccggg

SEQ ID NO: 177532 - DNA, 535 bp, Homo sapiens
  misc_feature: GYAE6OF01CTCG5.33.10.A10.1.454.CMB.1.raw
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgaatagaaaaataaatactatgcggactccgtgaagggccattcagcatctccagagacaattccaaagaacacgttgtaatctgacaaatgaacggtgtgagacctgacgacacggctgtgtatttcngtgacgaaagattatacgatgatttgacttggttactntggagggtgtggcgacgtgggcgagggaaccgtggtcatcgtctcctcncgctccacgaacggcccacgtccgtccttcccctcggccctccctccctccaacgacgcacccgtcgtcggggcacgacgccggcccgtcgggctaggccgtggttcgtaaaccgg

SEQ ID NO: 177533 - DNA, 561 bp, Homo sapiens
  misc_feature: GYAE6OF01DPB90.33.10.A10.1.454.CMB.1.raw
  modified_base (332)..(332): a, c, t, g, unknown or other
  misc_feature (332)..(332): n is a, c, g, or t
  modified_base (493)..(493): a, c, t, g, unknown or other
  misc_feature (493)..(493): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaagggggctggagtggctatcagttatatcacatgatagaaaaataaatactatgcggactccgtgaagggccgattcagcatctccagagacaattccaagaacacgttgtatctgacaaatgaaacggtgtgagacctgacgacacggctgtgtatttcngtgacgtaaaagtatttaacgtacgaattggtaatttggaacgttggtttaactcgtggtaggggtggtgggcgtacgtcggggccgaacgggtaaccgtcggtctacgtcgtctcctcacgcctccacgaacggcccacgtccgtccttccccgtcgccnccctcctacccgaagccgcgaccgtcgtcggggcacgacgcggcccgtgggctgccctggtcgaacgg

SEQ ID NO: 177534 - DNA, 605 bp, Homo sapiens
  misc_feature: GYAE6OF01EGKC5.33.10.A10.1.454.CMB.1.raw
  modified_base (336)..(336): a, c, t, g, unknown or other
  misc_feature (336)..(336): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttcagttactatggcatgcactgggtccgccaggctccaggcgaaggggctggagtggctatcagttatatcacatgatagaaaataatactatgcggactccgtgaacggccgattcagcatctccaganacaattccaaagaactacgttagtatctgacaaatggaacggttgtaggaacgtacccgtaggaaccgaacgaacgggtcttggttgttattttcgtgtagacgaaagtatttaatacgattgtattttgacgttgggttactcgtagggtagggggttgtcgggacggtacggttcggggggaccctaagggggtaacccccttggggtacccaggtttccccgttccgttacccctaccgaaccgtccccctacccgaaaccccggg

SEQ ID NO: 177535 - DNA, 248 bp, Homo sapiens
  misc_feature: GYAE6OF01ALQ65.33.10.A10.1.454.CMB.1.raw
  modified_base (244)..(248): a, c, t, g, unknown or other
  misc_feature (244)..(248): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 177536 - DNA, 214 bp, Homo sapiens
  misc_feature: GYAE6OF01EGOOX.33.10.A10.1.454.CMB.1.raw
  modified_base (205)..(214): a, c, t, g, unknown or other
  misc_feature (205)..(214): n is a, c, g, or t
tcagtacacacactcacgaccggtgctcgatttagcgtcgatctcgagggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagnnnnnnnnnn

SEQ ID NO: 177537 - DNA, 208 bp, Homo sapiens
  misc_feature: GYAE6OF01CV0F6.33.10.A10.1.454.CMB.1.raw
  modified_base (203)..(208): a, c, t, g, unknown or other
  misc_feature (203)..(208): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagnnnnnn

SEQ ID NO: 177538 - DNA, 643 bp, Homo sapiens
  misc_feature: GYAE6OF01CT2II.33.10.A10.1.454.CMB.1.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagcctggggggtccctgagactctcctgtgcagcctctggattcaccttcagtttacatggcatgcactgggtccnccaggctccaggcaaggggctggagtggctatcagttanatcacatagatagaaaaactaatactagtcgacgactccggtagaacgggccattcagcatctacagagactaattaccaaagaactacgtttgacttacgtgacaaatggaaaccggttgtacgaacgtaccctaggaaccctacgaacgggtccttggttacgttaatttccgtggtacgtaacgtaaagtatttaacgttaacgattagtacgttttacggactttacgggttaacttccggtgggtaacggggttggtacgggaccgggtacgggttcgggggacccgtaacggggtaaccccttggggtaacctaggtttacccgtcccgttacctcggaacccgtccccgttaccgaaaccccggg

SEQ ID NO: 177539 - DNA, 650 bp, Homo sapiens
  misc_feature: GYAE6OF01C52ML.33.10.A10.1.454.CMB.1.raw
  modified_base (274)..(274): a, c, t, g, unknown or other
  misc_feature (274)..(274): n is a, c, g, or t
  modified_base (330)..(330): a, c, t, g, unknown or other
  misc_feature (330)..(330): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccccagactctcctgtgcagcctctggattcaccttcagttactatggcatgcacgtgggtccgccaggcctccgaggcaaggggctggagtggctatcagttanatcacatgatagaaaataatactatgcgactcgtagaaggcatcagcatcacaganacattaccaaagaactagttgtatcgtagactaaatcggaacggtgtagacgtacctgaaccgacgacggtcttaggtgttactttcgtaggtacgacgtaaaagttactttaagttacgtaagttaggtaagtttttacggaacggttttacgggtttaaccttcggtttaggggtaggggggttgttacgggggtccggtaaaccgggttcggggggaccccgtaaacgggggtaacccccgtttgggtccctaacgttcccggttaccgttcccctacggaccgtaccccgtacccgtaaccccggtaaacccgggg

SEQ ID NO: 177540 - DNA, 265 bp, Homo sapiens
  misc_feature: GYAE6OF01BATLY.33.10.A10.1.454.CMB.1.raw
  modified_base (248)..(265): a, c, t, g, unknown or other
  misc_feature (248)..(265): n is a, c, g, or t
tcagtacacacactcacgaccggtgctcgatttagcgtcgatctcgaggggtcttcgtggctccacgtccaccaccacgcatgtgacctcaggggtccgggagatcatgagggtgtccttggggtttgggggaagaggaagactgacggtccccccaggagttcaggtgctgggcacagcggcctgggctgcctggtcaaggactacgttccagtgtgtgtactgagcgggctggcaaggcgcatagnnnnnnnnnnnnnnnnnn

SEQ ID NO: 177541 - DNA, 554 bp, Homo sapiens
  misc_feature: GYAE6OF01B6H1F.33.10.A10.1.454.CMB.1.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgatgaaaaataatactatgcggactccgtgaagggccgattcagcatctcagagacaattccaagaacacgttgaatctgacaaaatgaacggtgtgacgacctggacgacacggctgtgtatttcngtgacgaaaagtnttaattacgatgatttgactggttactntgagggtgtggcgacgtgggcgaagggaacccgtggtcacgtcgtctcctcacgcctccaaccgaaccgggaccctacgtccggttccttcccccgtcggccctacccctccctaccgaacgacgccgtaccgtcgtggggccacgacgcccggcccgtcgggctcggcctgggtctaacggg

SEQ ID NO: 177542 - DNA, 550 bp, Homo sapiens
  misc_feature: GYAE6OF01AC8VH.33.10.A10.1.454.CMB.1.raw
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatagaaaataatactatgcggactccgtagaaggccattcagcatctccagacgacaattccaagaacacgttgtatctagacaaagtgaacggtntagacgacctgacgacgacggtcttgtgttatttcgngtcgacgaaagtattatagattgtatttgacttggttactcgtaggtaggggttgtacggtcgacggtcggggccaggggtaaccctgggtacctagttaccgtccttacctaccgacgtcccgtacccgaacccgg

SEQ ID NO: 177543 - DNA, 574 bp, Homo sapiens
  misc_feature: GYAE6OF01D8ASG.33.10.A10.1.454.CMB.1.raw
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgatagaaaataaatactatgcggactccgtagagggccgattcagcatctccagagacaattccaagaacacgttgtatctgacaaatggaacggtgtgagacctgacgacacggctggtgttatttctgtgacgaaagtattatacgatgtatttgacgttggttactgtggtagggtgtggcgacggtcgggaccgaacgggaaccgttggtctagttccgtcctcctcacgcctcccgaacgaaccggtacccacgttccgttcccttcccccgtcggccctaccctccctaccgaacgacgcctaccgtcggtggggacctaccgacggcccggcccgtcgggcctcggccgtggtaccgtaacggg

SEQ ID NO: 177544 - DNA, 544 bp, Homo sapiens
  misc_feature: GYAE6OF01EQTZ5.33.10.A10.1.454.CMB.1.raw
  modified_base (334)..(334): a, c, t, g, unknown or other
  misc_feature (334)..(334): n is a, c, g, or t
  modified_base (421)..(421): a, c, t, g, unknown or other
  misc_feature (421)..(421): n is a, c, g, or t
  modified_base (465)..(465): a, c, t, g, unknown or other
  misc_feature (465)..(465): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctgggggtccctgagactctcctgtgcagcctctggattcaccttcagttactatggcatgcacgtgggtccgccaggctccgaggcaaggggctggagtggctatcagttatatcacatgatagaaaataatacatgacgactccgtagaacgggccattcagcatctcaganacaattccaaagacacgttgatctgacaaatgaacggtgtgagacctagacgacacggctgtagttatttcgtgtcgacgtaaagtntttatacgatgtatttgacgtttggttactcggtaggtggggtntgggcgtacggtgggggaccctaggggaacccctgggtaccagttccgtcctcccgtacgacgtccctaccgaacccgg

SEQ ID NO: 177545 - DNA, 558 bp, Homo sapiens
  misc_feature: GYAE6OF01A5BL5.33.10.A10.1.454.CMB.1.raw
  modified_base (233)..(233): a, c, t, g, unknown or other
  misc_feature (233)..(233): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccnccaggctccaggcaaggggctggagtggctatcagttatatcacatgatagaaaataaatactatgcggactccgtgaagggccgattcagcatctccagagacaattccaaagaacacgttgtatctgacaaatggaacggttgtagaagacctgacgacacggctgtgttatttcgngtgacgaaagtntttaattacgattgtatttggacttggtttactcgtaggtaggggttgtgggccgacggtgggggaccctaaggggtaaccccttgggtaccagttccgttcccttcctacgacgtcccctcccgtaaacccgg

SEQ ID NO: 177546 - DNA, 205 bp, Homo sapiens
  misc_feature: GYAE6OF01BB9UR.33.10.A10.1.454.CMB.1.raw
  modified_base (202)..(205): a, c, t, g, unknown or other
  misc_feature (202)..(205): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177547 - DNA, 526 bp, Homo sapiens
  misc_feature: GYAE6OF01C2Y3U.33.10.A10.1.454.CMB.1.raw
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcacgtgggtccgccaggctccaggcaaggggctggagtggctatcagttatatcacatgatagaaaataatactatgcggactcgtagaggccattcagcatctccagagacaattccaagacacgttgtatcngacaaatgaacggtgtgagacctgacgacacggctgtntatttcgngtgacgaaagtnttagtacgatgtatttgacttggttactgtggtagggtgtggcgacgtcgggaccgacgggaccgtggtcagtcgtctcctcgacgcctaccaccgacggcctacgtccgtccttcccgtcgccctaccctcctaccacgcgcaccgtcgngggcncgcgccggccgtcggctgccgtggtcgaacgg

SEQ ID NO: 177548 - DNA, 529 bp, Homo sapiens
  misc_feature: GYAE6OF01BMHBC.33.10.A10.1.454.CMB.1.raw
  modified_base (327)..(327): a, c, t, g, unknown or other
  misc_feature (327)..(327): n is a, c, g, or t
  modified_base (405)..(405): a, c, t, g, unknown or other
  misc_feature (405)..(405): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatagaaaataaatactatgcggactccgtgaagggccatcagcatcncagagacaattccaagaacacgttagtatctagacaaatgaacggtgtagagacctgacgacacggctgtagtatttngtgacgaaagtattaagttacgattgatttagacttggtttaactgtggaggggttgtcggcggtacgtggggcctaggggaacccctgggtccagtcgtctccacacgtccctccgaacccgg

SEQ ID NO: 177549 - DNA, 203 bp, Homo sapiens
  misc_feature: GYAE6OF01A8DHI.33.10.A10.1.454.CMB.1.raw
  modified_base (203)..(203): a, c, t, g, unknown or other
  misc_feature (203)..(203): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagn

SEQ ID NO: 177550 - DNA, 537 bp, Homo sapiens
  misc_feature: GYAE6OF01DH5JX.33.10.A10.1.454.CMB.1.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcgaggtgcatctgggtggagtctgggggaggcgtggtccagccgtggggggtccctgagactctcctgtgcagcctctggattcaccttcagttactatggcatgcacgtgggtccgccaggctccaggcaaggggctggagtggctatcagttatatcacatgatagaaaataatactatgcgactccgtagaacgggccgattcagcatctaccagaacgactaattaccaaagaactacgttgtatctgacaatgaacgtgtagagactgacgacacggntgtnttatttctgtgacgaagtatttatacgattgtatttgattggttactgtaggagggtgtcggcggtaggtcggggacctaaggggaccctgggtaccagtccgtcctcctcgaccgcctcccgaacccgg

SEQ ID NO: 177551 - DNA, 622 bp, Homo sapiens
  misc_feature: GYAE6OF01D2XR8.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactcgggtccgccaggctccaggcgaaggggctggagtggctatcagttatatcacatgatagaaaataatactatgcgactcgtgaacggcatcagcatctcagagacaattaccaaagaactacgttgtatctagactaagtggaacggtgtagacgtacctagaccgacgacggctggttgttatttcgtgtgaacgtaaagttatttaagttacgtaagtagttattttacgtacgtttacggtttacgttcggttaggggtagggggtttggtaggggcccggttaacgggttccggggggacccgtaaacgggggtaaccccgttggggtaccctacgttacccggttcccttacccgttaccgaaccggtccccctacccgtaaaccccggg

SEQ ID NO: 177552 - DNA, 232 bp, Homo sapiens
  misc_feature: GYAE6OF01BJOWM.33.10.A10.1.454.CMB.1.raw
  modified_base (204)..(232): a, c, t, g, unknown or other
  misc_feature (204)..(232): n is a, c, g, or t
tcagtacacacactcacgaccggtgctcgatttagcgtcgatctcgaggggtccggggagatcatgacgggtgtccttgggtttgggggaagaggaagactgacggtcccccaggacgttcaggtgctgggcacagcggccctgggctgcctggtcaaggctacttccagtgtgtgtactgagcgggctggcaaggcgcatagnnnnnnnnnnnnnnnnnnnnnnnnnnnnn
